United States Patent
Hadjivassiliou et al.

(10) Patent No.: US 12,428,488 B2
(45) Date of Patent: Sep. 30, 2025

(54) ENGINEERING OF AN ANTIBODY FOR TUMOR-SELECTIVE BINDING OF CD47

(71) Applicant: CELGENE CORPORATION, Summit, NJ (US)

(72) Inventors: Haralambos Hadjivassiliou, Summit, NJ (US); Dan Zhu, Summit, NJ (US); Jeonghoon Sun, Summit, NJ (US); Sharmistha Acharya, Summit, NJ (US); Jeffrey Johnson, Summit, NJ (US); Henry Chan, Summit, NJ (US); Kandasamy Hariharan, Summit, NJ (US); Ho Cho, Summit, NJ (US)

(73) Assignee: CELGENE CORPORATION, Summit, NJ (US)

( * ) Notice: Subject to any disclaimer, the term of this patent is extended or adjusted under 35 U.S.C. 154(b) by 998 days.

(21) Appl. No.: 17/594,131

(22) PCT Filed: Apr. 3, 2020

(86) PCT No.: PCT/US2020/026575
§ 371 (c)(1),
(2) Date: Oct. 4, 2021

(87) PCT Pub. No.: WO2020/206251
PCT Pub. Date: Oct. 8, 2020

(65) Prior Publication Data
US 2022/0340675 A1    Oct. 27, 2022

Related U.S. Application Data

(60) Provisional application No. 62/830,335, filed on Apr. 5, 2019.

(51) Int. Cl.
C07K 16/28        (2006.01)
A61K 39/00        (2006.01)
A61P 35/00        (2006.01)

(52) U.S. Cl.
CPC .......... *C07K 16/2887* (2013.01); *A61P 35/00* (2018.01); *C07K 16/2803* (2013.01); *C07K 16/2863* (2013.01); *A61K 2039/505* (2013.01); *C07K 2317/21* (2013.01); *C07K 2317/24* (2013.01); *C07K 2317/31* (2013.01); *C07K 2317/33* (2013.01); *C07K 2317/34* (2013.01); *C07K 2317/55* (2013.01); *C07K 2317/565* (2013.01); *C07K 2317/732* (2013.01); *C07K 2317/734* (2013.01); *C07K 2317/76* (2013.01); *C07K 2317/92* (2013.01)

(58) Field of Classification Search
CPC ...... A61P 35/00; A61P 35/02; C07K 16/2887; C07K 2317/31; C07K 2317/565; C07K 16/2803; C07K 16/2863; C07K 2317/21; C07K 2317/24; C07K 2317/33; C07K 2317/34; C07K 2317/55; C07K 2317/732; C07K 2317/734; C07K 2317/76; C07K 2317/92; C07K 2317/73; C07K 2317/90; A61K 2039/505
See application file for complete search history.

(56) References Cited

U.S. PATENT DOCUMENTS

| | | |
|---|---|---|
| 2018/0201677 A1 | 7/2018 | Grosveld et al. |
| 2018/0291115 A1 | 10/2018 | Masternak et al. |
| 2019/0048075 A1 | 2/2019 | Weissman et al. |

FOREIGN PATENT DOCUMENTS

| | | |
|---|---|---|
| CA | 3 078 413 A1 | 4/2019 |
| CN | 110885376 A | 3/2020 |
| JP | 2017-525698 A | 9/2017 |
| JP | 2018500017 A | 1/2018 |
| TW | 202104260 A | 2/2021 |
| WO | 2011-034969 A1 | 3/2011 |
| WO | 2013/119714 A1 | 5/2013 |
| WO | 2014/054804 A1 | 4/2014 |
| WO | 2014/104165 | 7/2014 |
| WO | 2014/123580 A1 | 8/2014 |
| WO | 2016022971 A1 | 2/2016 |
| WO | 2016/109415 | 7/2016 |
| WO | 2017121771 A1 | 7/2017 |
| WO | 2018/009499 A1 | 1/2018 |
| WO | 2018/035084 A1 | 2/2018 |
| WO | 2018/155611 A1 | 8/2018 |
| WO | 2018/183182 A1 | 10/2018 |

OTHER PUBLICATIONS

Weiskopf, K., et al., Eradication of Canine Diffuse Large B-Cell Lymphoma in a Murine Xenograft Model with CD47 Blockade and Anti-CD20, Cancer Immunol Res. Dec. 2016 ; 4(12): 1072-1087.
Russ, A., et al., Blocking 'don't eat me' signal of CD47-SIRPα in hematological malignancies, an in-depth review, Blood Rev. Nov. 2018 ; 32(6): 480-489.

(Continued)

*Primary Examiner* — Misook Yu
*Assistant Examiner* — James Lyle McLellan
(74) *Attorney, Agent, or Firm* — Debora Plehn-Dujowich; Eckert Seamans Cherin & Mellott, LLC

(57) ABSTRACT

Antibodies are provided which comprise at least one Fab portion that binds CD47 and at least one Fab portion that binds the tumor associated antigen (TAA) CD20; wherein the Fab portion that binds CD47 exhibits low affinity for CD47; and, wherein the Fab portion that binds CD20 exhibits high affinity for CD20; and, wherein the antibody selectively binds CD47 and blocks CD47 interaction with SIRPα in tumor cells while exhibiting no substantial binding to CD47 in normal cells.

17 Claims, 24 Drawing Sheets
Specification includes a Sequence Listing.

(56) References Cited

OTHER PUBLICATIONS

Piccione, Emily C., et al., "A bispecific antibody targeting CD47 and CD20 selectively binds and eliminates dual antigen expressing lymphoma cells", MABS, US, (Jun. 17, 2015), vol. 7, No. 5, doi:10.1080/19420862.2015.1062192, ISSN 1942-0862, pp. 946-956.
Dheilly, Elie, et al, "Selective Blockade of the Ubiquitous Checkpoint Receptor CD47 Is Enabled by Dual-Targeting Bispecific Antibodies", Molecular Therapy : the Journal of the American Society of Gene Therapy, US, (Feb. 1, 2017), vol. 25, No. 2, doi:10.1016/j.ymthe.2016.11.006, ISSN 1525-0016, pp. 523-533.
Van Bommel, Peter, E., et al., "CD20-selective inhibition of CD47-SIRP[alpha] "don't eat me" signaling with a bispecific antibody-derivative enhances the anticancer activity of daratumumab, alemtuzumab and obinutuzumab", Omcoimmunology, (Oct. 31, 2017), vol. 7, No. 2, doi:10.1080/2162402X.2017.1386361, pp. 1-8.
Bortoletto, Nicola, et al, "Optimizing anti-CD3 affinity for effective T cell targeting against tumor cells", European Journal of Immunology, Wiley VCH, Weinheim, (Nov. 1, 2002), vol. 32, No. 11.
Buatois, Vanessa , et al., "Preclinical Development Of a Bispecific Antibody that Safely and Effectively Targets CD19 and CD47 for the Treatment of B-Cell Lymphoma and Leukemia", Molecular Cancer Therapeutics, vol. 17, No. 8, May 9, 2018.
Chao, M. P., et al., "Anti-CD47 Antibody Synergizes with Rituximab to Promote Phagocytosis and Eradicate Non-Hodgkin Lymphoma", Cell 142, Sep. 3, 2010.
Tian, W., et al., "Abstract 545: Preclinical development of a bispecific antibody-trap selectively targeting CD47 and CD20 for the treatment of B cell lineage cancer", American Association for Cancer Research, vol. 79, Issue 13 Supplement Mar. 29, 2019.
International Search Report of PCT/US2020/026575, mail date Jul. 17, 2020.
International Written Opinion of PCT/US2020/026575, mail date Jul. 17, 2020.
International Preliminary Report on Patentability of PCT/US2020/026575, maile date May 28, 2021.
International Search Report of PCT/US2020/026579, mail date Jul. 7, 2020.
International Written Opinion of PCT/US2020/026579, mail date Jul. 7, 2020.
International Preliminary Report on Patentability of PCT/US2020/026579, mail date Jun. 10, 2021.
Rudikoff S. et al, "Single amino acid substitution altering antigen-binding specificity", Proceedings of the National Academy of Sciences, National Academy of Sciences, US, (Mar. 1, 1982), vol. 79, No. 6, doi:10.1073/PNAS.79.6.1979, ISSN 0027-8424, pp. 1979-1983.
Y.W. Wong, et al: "Structural requirements for a specificity switch and for maintenance of affinity using mutational analysis of a phage-displayed anti-arsonate antibody of Fab heavy chain first complementarity-determining region". J Immunol. Jun. 15, 1998;160(12):5990-7.

Z. Liu, et al: "Fine mapping of the antigen-antibody interaction of scFv215, a recombinant antibody inhibiting RNA polymerase II from *Drosophila melanogaster*". J Mol Recognit. Mar.-Apr. 1999;12(2):103-11.
Paul H. Kussie et al: "A Single Engineered Amino Acid Substitution Changes Antibody Fine Specificity". journal of Immunology, 1994, 152: 146-152.
J Panka, et al: "Variable region framework differences result in decreased or increased affinity of variant anti-digoxin antibodies". Proc Natl Acad Sci U S A. May 1988;85(9):3080-4.
Inbal Sela-Culang et al, "The Structural Basis of Antibody-Antigen Recognition", Frontiers in Immunology, (Oct. 8, 2013), vol. 4.
Mathieu Dondelinger et al, "Understanding the Significance and Implications of Antibody Numbering and Antigen-Binding Surface/Residue Definition", Frontiers in Immunology, (Oct. 16, 2018), vol. 9, pp. 1-15.
Vered Kunik, et al: "Structural consensus among antibodies defines the antigen binding site." PLoS Comput Biol. 2012;8(2).
Christian Klein, et al: "Epitope interactions of monoclonal antibodies targeting CD20 and their relationship to functional properties". MAbs. Jan. 1, 2013; 5(1): 22-33.
Kipriyanov, S. M., et al., Bispecific CD33CD19 Diabody for T Cell-Mediated Lysisof Malignant Human B Cells, Int. J. Cancer 77 (1998), 763-772.
Feng, M., et al., Phagocytosis checkpoints as new targets for cancer immunotherapy, Nat Rev Cancer. Oct. 2019; 19(10):568-586.
Gunasekaran, K., et al., Enhancing antibody Fc heterodimer formation through electrostatic steering effects: applications to bispecific molecules and monovalent IgG, J. Biol. Chem. 285 (2010) 19637-19646.
Sharpe, A. H. Introduction to checkpoint inhibitors and cancer immunotherapy. Immunol Rev. Mar. 2017;276(1):5-8.
Matlung, H.L., et al., Szilagyi K, Barclay NA, van den Berg TK. The CD47-SIRPa signaling axis as an innate immune checkpoint in cancer. Immunol Rev. Mar. 2017;276(1):145-164.
Veillette, A., et al., (SIRP)α-CD47 Immune Checkpoint Blockade in Anticancer Therapy. Trends in Immunology, 2018, 39(3):173-184.
Veillette A., et al., Signaling Regulatory Protein (SIRP)α-CD47 Blockade Joins the Ranks of Immune Checkpoint Inhibition. J Clin Oncol. Feb. 27, 2019.
Chothia & Lesk, Canonical Structures for the Hypervariable Regions of Immunoglobulins, J. Mol. Biol. 196, 901-917 (1987).
Lefranc, M-P., et al., "IMGT Unique Numbering for Immunoglobulin and Cell Receptor Variable Domains and Ig superfamily V-like domains," Dev. Comp. Immunol. 27, 55-77 (2003).
Weiskopf K., et al., Cancer immunotherapy targeting the CD47/SIRPα axis, Eur J Cancer. May 2017;76:100.
Ridgway, J. B., et al., 'Knobs-into-holes' engineering of antibody CH3 domains for heavy chain heterodimerization, Protein Eng. 9 (1996) 617-621.
Denny, TN et al., Quantitative Determination of Surface Antibody Binding Capacities of Immune Subsets Present in Peripheral Blood of Healthy Adult Donors, Cytometry, Dec. 1996;26(4):265-74.
He, M. and Taussig, M.J., Rapid discovery of protein interactions by cell-free protein technologies, Biochem Soc Trans. Nov. 2007;35(Pt 5):962-5.

| CD47/CD20 VARIANT | HUMAN CD47 $K_D$ (µM) | OCI-Ly3 Mφ EC50 (µg/mL) | OCI-Ly3 Mφ EC50 (µg/mL) REPEAT |
|---|---|---|---|
| TPP-1360 | 1.7 | 0.21 (1.4 nM) | 0.27 (1.8 nM) |
| TPP-1361 | 2.53 | 0.50 (3.3 nM) | 0.45 (3.0 nM) |
| TPP-1362 | 0.91 | 0.065 (0.43 nM) | 0.056 (0.37 nM) |
| TPP-1367 | 0.43 | 0.064 (0.42 nM) | 0.046 (0.31 nM) |

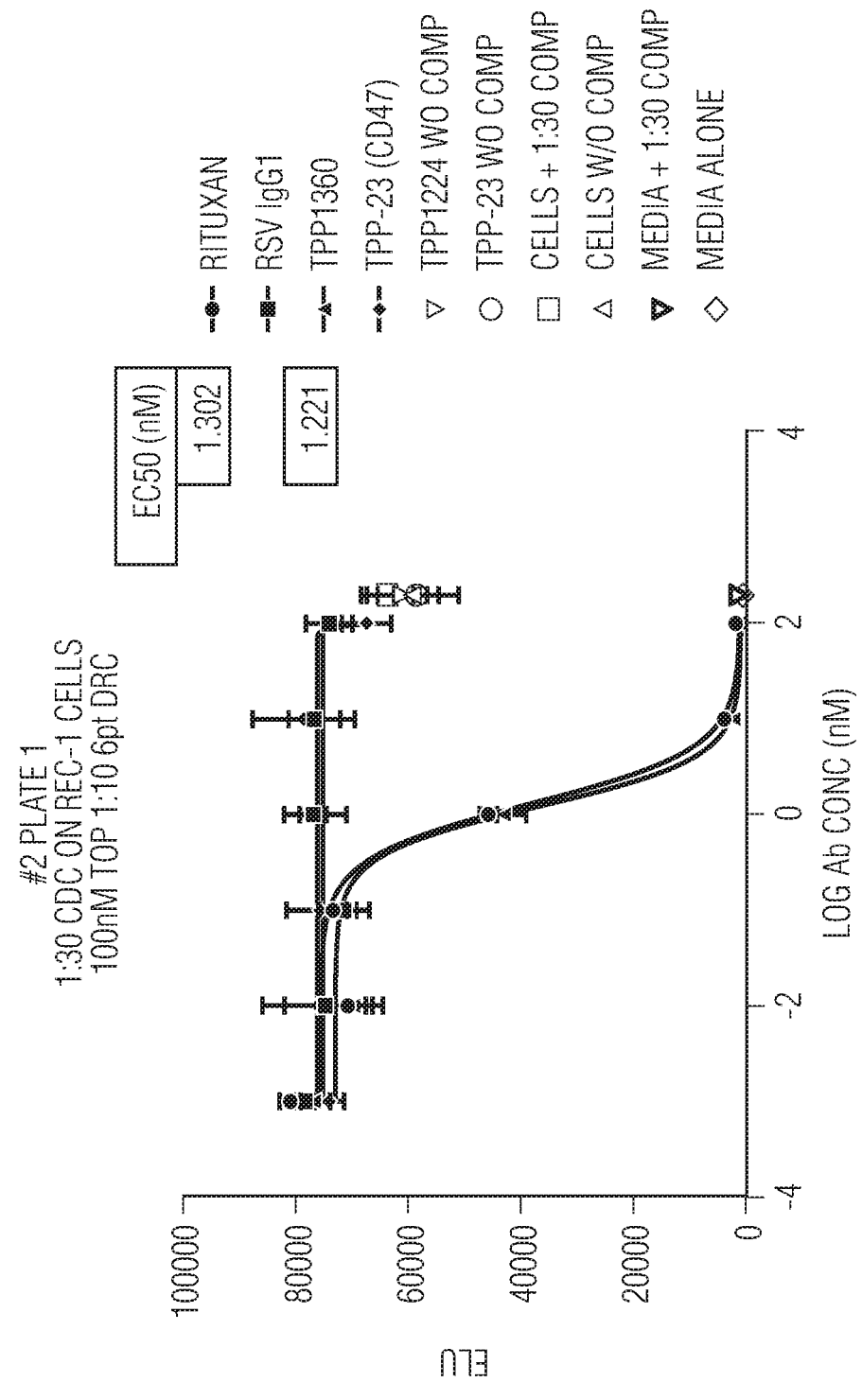

| Cell Line | CD20 ABC | CD47 ABC | CD20/CD47 Ratio |
|---|---|---|---|
| OCI-Ly3 | 154,000 | 247,000 | 0.62 |
| Raji | 522,596 | 213,927 | 2.44 |

Both CD47xCD20 (TPP-1362 and TPP-1360) induce significantly higher level of ADCC than Rituxan TPP-1360 Binds Selectively to B Cells in Human Whole Blood CD = cluster of differentiation; IgG1 = immunoglobulin G1; MFI = mean fluorescence intensity; NK = natural killer; RBC = red blood cells; RSV = respiratory syncytial virus.

CD = cluster of differentiation; IgG1 = immunoglobulin G1; MFI = mean fluorescence intensity; RBC = red blood cells; RSV = respiratory syncytial virus; WT = wild-type.

ENGINEERING OF AN ANTIBODY FOR TUMOR-SELECTIVE BINDING OF CD47

CROSS-REFERENCE TO RELATED APPLICATIONS

The present application is a 35 U.S.C. § 371 National Phase Application from International Application No. PCT/US2020/026575, filed Apr. 3, 2020 which is entitled to priority under 35 U.S.C. § 119(e) to U.S. Provisional Application No. 62/830,335, filed Apr. 5, 2019, each of which is hereby incorporated by reference in its entirety.

FIELD OF THE INVENTION

Provided herein are tumor-selective antibodies, pharmaceutical compositions, and methods of use for the treatment of pathological conditions effected by cells undergoing aberrant proliferation, including hematological oncology conditions, hematological malignancies, lymphoproliferative disorders, B-cell disorders, B-cell malignancies, and B-cell lymphoma.

SEQUENCE LISTING

The instant application contains a Sequence Listing which has been submitted in ASCII format via EFS-Web and is hereby incorporated by reference in its entirety. The ASCII copy, created on Feb. 26, 2022, is named 298068-00374_Sequence_Listing_new.txt and is 627,297 bytes in size.

BACKGROUND OF THE INVENTION

Over the past decade, the use of blocking agents against inhibitory immune checkpoints has been one of the most significant advances in anticancer treatment (Sharpe A H. Introduction to checkpoint inhibitors and cancer immunotherapy. Immunol Rev. 2017 March; 276(1):5-8). The exciting results obtained with CTLA-4 and PD-1 blockade led to the evaluation of several innate immune checkpoints that could be targeted in anticancer treatment, in particular pathways regulating macrophage function. Macrophages express SIRPα which interacts with CD47, a ubiquitously expressed protein that mediates a "don't eat me" signal that functions to inhibit phagocytosis. Expression of CD47 confers resistance to phagocytosis of antibody-bound tumor cells by macrophages. In the absence of CD47 binding to SIRPα, antibodies that can bind Fc-receptor on macrophages can enhance phagocytosis of these cells. Cancer cells have evolved to hijack this interaction by upregulating the expression of CD47 on their cell surface, thus counterbalancing pro-phagocytic signals and increasing the chances of evading innate immune surveillance (Matlung H L, Szilagyi K, Barclay N A, van den Berg T K. The CD47-SIRPα signaling axis as an innate immune checkpoint in cancer. Immunol Rev. 2017 March; 276(1):145-164). Therefore, blockade of the CD47-SIRPα interaction represents a promising therapeutic strategy to activate the phagocytic clearance of tumor cells from the body. Several SIRPα-CD47 blocking agents, including humanized and fully human anti-CD47 antibodies, anti-SIRPα antibodies, soluble SIRPα dimers fused to the Fc portion of human IgG, high-affinity monomeric SIRPα devoid of Fc portion, and camelid-derived monomeric fragments of anti-CD47 antibodies (nanobodies), have shown efficacy in vitro and in preclinical studies against various types of human tumors (Veillette A, Chen A., SIRPα-CD47 Immune Checkpoint Blockade in Anticancer Therapy. Trends in Immunology, 2018, 39(3):173-184). Some of the SIRPα-CD47 blocking agents, including CC-90002 (anti-CD47), Forty Seven's anti-CD47 (Hu5F9-G4) and Trillium's SIRPα-fusion Fc have been tested in phase I and phase II clinical trials, respectively (Veillette A, Tang Z. Signaling Regulatory Protein (SIRP)α-CD47 Blockade Joins the Ranks of Immune Checkpoint Inhibition. J Clin Oncol. 2019 Feb. 27:JC0190012). These approaches in the clinic are limited by the need for combination therapy (e.g., rituximab), the tissue sink (i.e., presence of non-tumor cells to which the therapeutic antibody binds, thus decreasing the bioavailability of the antibody for tumor cells) in targeting CD47 with a high-affinity binder, and the observed hematologic toxicity with some of the clinical molecules (anemia, neutropenia, and/or thrombocytopenia). Importantly, while protein therapeutics are indeed explored to treat a number of diseases, biopharmaceutical entities can prompt an immune response involving production of anti-entity antibodies when administered to subjects which result in reduced efficacy and/or toxicity.

SUMMARY OF THE INVENTION

The present invention is directed to an antibody comprising at least one Fab portion that binds CD47 with low affinity and at least one Fab portion that binds CD20 with high affinity; wherein the bispecific antibody selectively binds CD47 in tumor cells and is substantially free of binding to CD47 in normal cells.

Fab portions described herein that bind CD47 with low affinity generally exhibit affinity for CD47 between about 0.1 µM and about 25 µM, for example, when measured as Kd (dissociation constant) by surface plasmon resonance (SPR). Fab portions described herein that bind CD47 with low affinity exhibit affinity for CD47 from about 0.25 µM to about 20 µM. Certain preferred embodiments exhibit affinity for CD47 from about 0.4 µM to about 4.0 µM. Certain embodiments exhibit affinity for CD47 from about 1 µM to about 3.0 µM. In some embodiments, for example, the Fab portion that binds CD47 exhibits an affinity for CD47 that is from about 0.1 µM to about 5.0 µM. In some embodiments, the Fab portion that binds CD47 exhibits an affinity for CD47 that is from about 0.1 µM to about 0.2 µM, 0.3 µM, 0.4 µM, 0.5 µM, 0.6 µM, 0.7 µM, 0.8 µM, 0.9 µM, 1.0 µM, 1.1 µM, 1.2 µM, 1.3 µM, 1.4 µM, 1.5 µM, 1.6 µM, 1.7 µM, 1.8 µM, 1.9 µM, 2.0 µM, 2.1 µM, 2.2 µM, 2.3 µM, 2.4 µM, 2.5 µM, 2.6 µM, 2.7 µM, 2.8 µM, 2.9 µM, 3.0 µM, 3.1 µM, 3.2 µM, 3.3 µM, 3.4 µM, 3.5 µM, 3.6 µM, 3.7 µM, 3.8 µM, 3.9 µM, 4.0 µM, 4.1 µM, 4.2 µM, 4.3 µM, 4.4 µM, 4.5 µM, 4.6 µM, 4.7 µM, 4.8 µM, 4.9 µM or about 5.0 µM.

In some embodiments, the Fab portion that binds CD47 exhibits an affinity for CD47 that is from about 0.2 µM to about 4.0 µM. In further embodiments, the Fab portion that binds CD47 exhibits an affinity for CD47 that is from about 0.5 µM to about 3.5 µM. In further embodiments, the Fab portion that binds CD47 exhibits an affinity for CD47 that is from about 1.0 µM to about 3.0 µM.

The present invention is further directed to an antibody comprising at least one Fab portion that binds CD47 and at least one Fab portion that binds CD20; wherein the Fab portion that binds CD47 exhibits low affinity for CD47; and, wherein the Fab portion that binds CD20 exhibits high affinity for CD20; and, wherein the bispecific antibody selectively binds CD47 in tumor cells and is substantially free of binding to CD47 in normal cells; and, wherein the antibody activates antibody-dependent cellular phagocytosis of the tumor cells which express CD20.

The present invention is further directed to an antibody comprising at least one Fab portion that binds CD47 and at least one Fab portion that binds CD20; wherein the Fab portion that binds CD47 exhibits low affinity for CD47; and, wherein the Fab portion that binds CD20 exhibits high affinity for CD20; and, wherein the bispecific antibody selectively binds CD47 in tumor cells and is substantially free of binding to CD47 in normal cells; and, wherein the antibody mediates complement-dependent cytotoxicity (CDC) of the tumor cells which express CD20.

The present invention is further directed to an antibody comprising at least one Fab portion that binds CD47 and at least one Fab portion that binds CD20; wherein the Fab portion that binds CD47 exhibits low affinity for CD47; and, wherein the Fab portion that binds CD20 exhibits high affinity for CD20; and, wherein the bispecific antibody selectively binds CD47 in tumor cells and is substantially free of binding to CD47 in normal cells; and, wherein the antibody mediates antibody-dependent cellular cytotoxicity (ADCC) of the tumor cells which express CD20.

The invention is further directed to monomeric elements of the IgG1 1+1 heterodimers described herein which contain certain light chain (LC) and heavy chain (HC) constant regions that drive the production of the IgG1 1+1 heterodimer format. In one embodiment, an anti-CD47 LC constant region that reduces LC mispairing during production comprises SEQ ID NO:340. In another embodiment, an anti-CD47 HC constant region that ensures heterodimer formation of the Fcs during production comprises SEQ ID NO:342. In another embodiment, an anti-CD20 LC constant region that reduces LC mispairing during production comprises SEQ ID NO:344. In another embodiment, an anti-CD20 HC constant region that ensures heterodimer formation of the Fcs during production comprises SEQ ID NO:346.

The invention is further directed to a bispecific antibody wherein the Fab portion that binds CD47 comprises (i) a light chain variable region (VL) region selected from the group consisting of SEQ ID NO:383, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495, SEQ ID NO:497, SEQ ID NO:499, SEQ ID NO:501, SEQ ID NO:503, SEQ ID NO:505, SEQ ID NO:507, SEQ ID NO:509, and SEQ ID NO:511; and, (ii) a heavy chain variable region (VH) region, selected from the group consisting of SEQ ID NO:384, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, and SEQ ID NO:512.

The invention is further directed to a bispecific antibody wherein the Fab portion that binds CD20 comprises anti-CD20 VL CDRs RASSSVSYIH (CDRL1; SEQ ID NO:353), ATSNLAS (CDRL2; SEQ ID NO:354), QQWTSNPPT (CDRL3; SEQ ID NO:355); and, VH CDRs SYNMH (CDRH1; SEQ ID NO:356), AIYPGNGDTSYN-QKFKG (CDRH2; SEQ ID NO:357), STYYGGDWYFNV (CDRH3; SEQ ID NO:358).

The invention is further directed to a bispecific antibody wherein the Fab portion that binds CD20 comprises anti-CD20 LC (SEQ ID NO:331) and anti-CD20 HC (SEQ ID NO:332).

The invention is further directed to a bispecific antibody wherein the Fab portion that binds CD47 comprises a light chain variable region (VL) region comprising VL CDRs RASQGISSWLA (CDRL1; SEQ ID NO:377), AASVLES (CDRL2; SEQ ID NO:378), and QQANSFPYT (CDRL3; SEQ ID NO:379); and, a heavy chain variable region (VH) region comprising VH CDRs NFVMS (CDRH1; SEQ ID NO:380), TISGSGGSTYYADSVKG (CDRH2; SEQ ID NO:381), HYILRYFD (CDRH3; SEQ ID NO:382).

The invention is further directed to a bispecific antibody wherein the Fab portion that binds CD47 comprises VL (SEQ ID NO:383); and VH (SEQ ID NO:384).

In addition, the current invention is directed to a pharmaceutical composition for the control of tumor cells, for administration to a patient in need thereof, comprising a bispecifc entity described herein.

In addition, the current invention is directed to a pharmaceutical composition for the treatment of a B-cell disorder or a B-cell malignancy, for administration to a patient in need thereof, comprising a bispecifc entity described herein.

The invention is further directed to a method of controlling tumor cells comprising administering an effective amount of a bispecifc entity described herein to a patient in need thereof.

Further the invention is directed to a method treatment of a B-cell disorder or a B-cell malignancy comprising administering an effective amount of a bispecifc entity described herein to a patient in need thereof.

TAA: Tumor Associated Antigen

Figure 2:
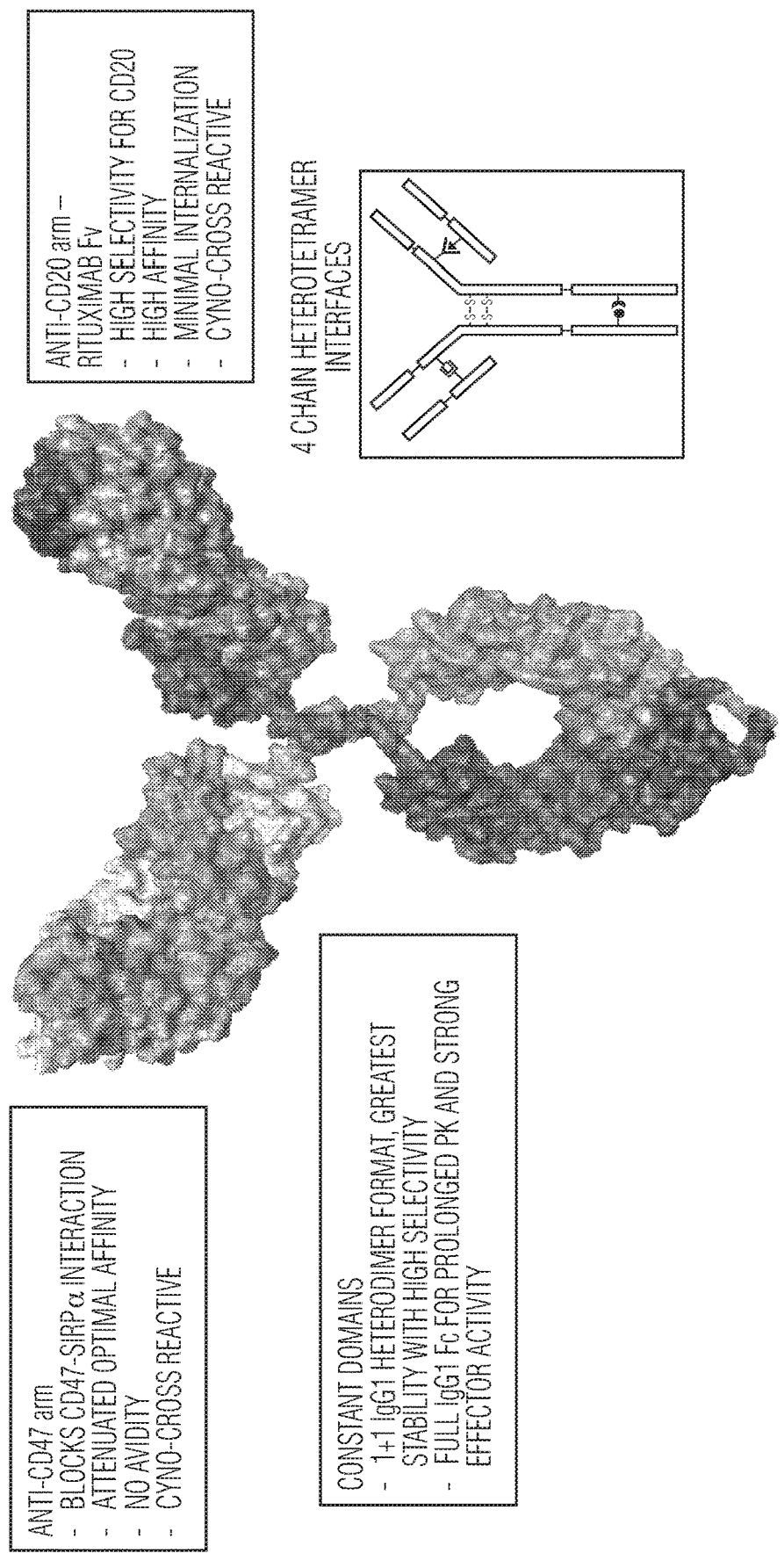

FIG. 2 illustrates an example bispecific entity architecture, protein engineering features, and several biopharmacological attributes.

Figure 3A:
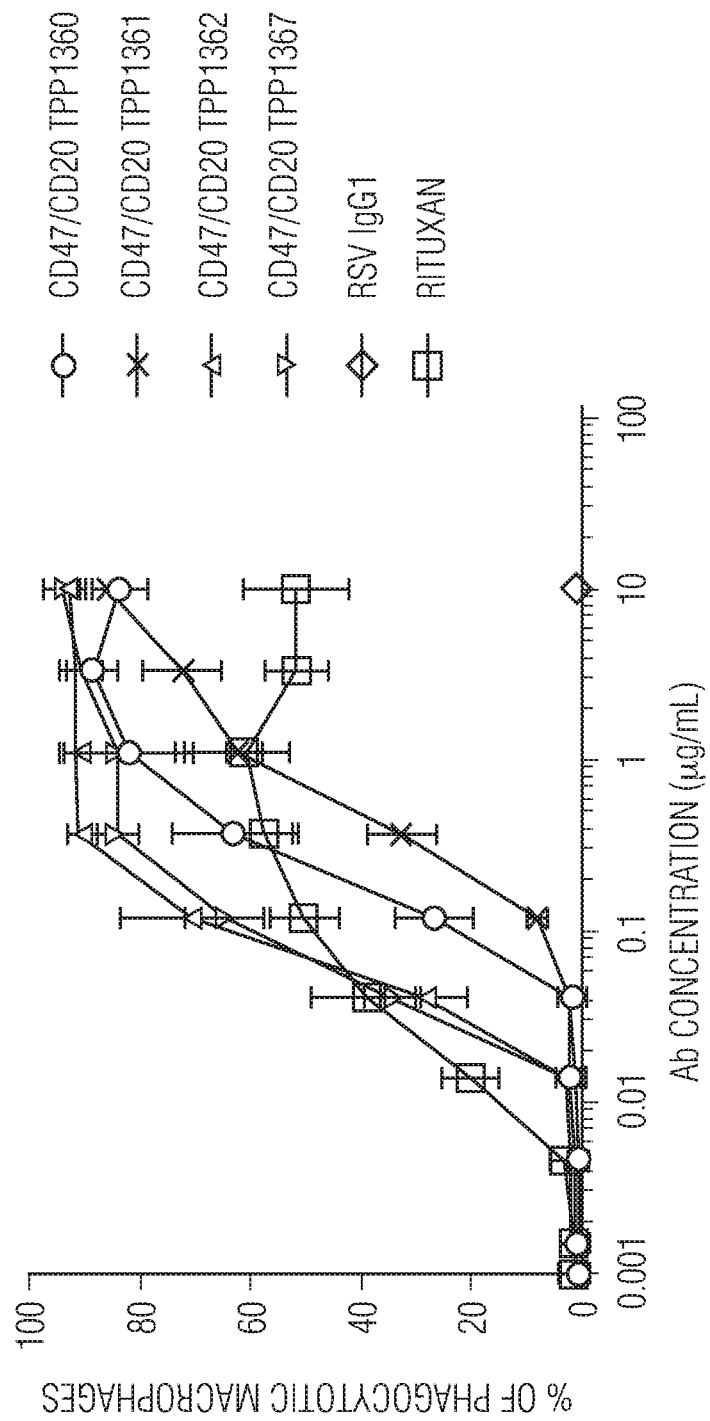
Figures 3B, 3C:
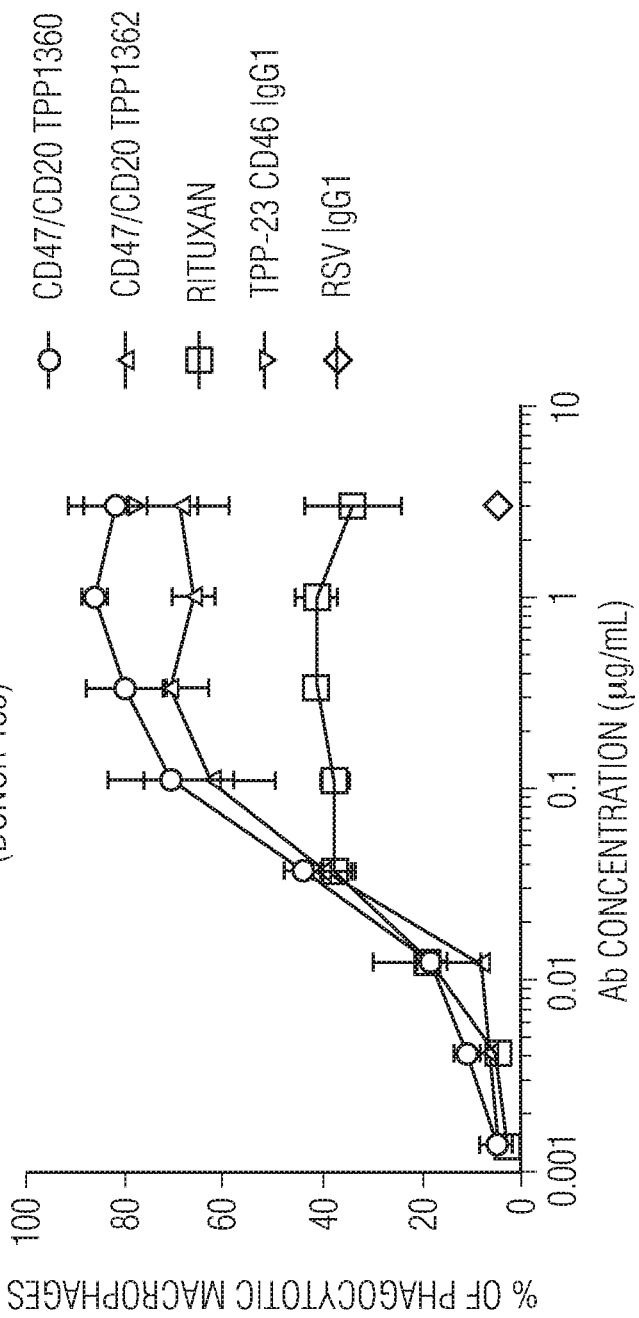

FIGS. 3A-3C show that example species bispecific entities described herein induce macrophage-mediated phagocytosis of CD20+CD47+OCI-Ly3 NHL cells. FIGS. 3A-3B are graphs that show the percentage of phagocytic macrophages in view of antibody concentration. FIG. 3C is a table showing KD and EC50 values for bispecific species described herein.

Figures 4B, 4C:
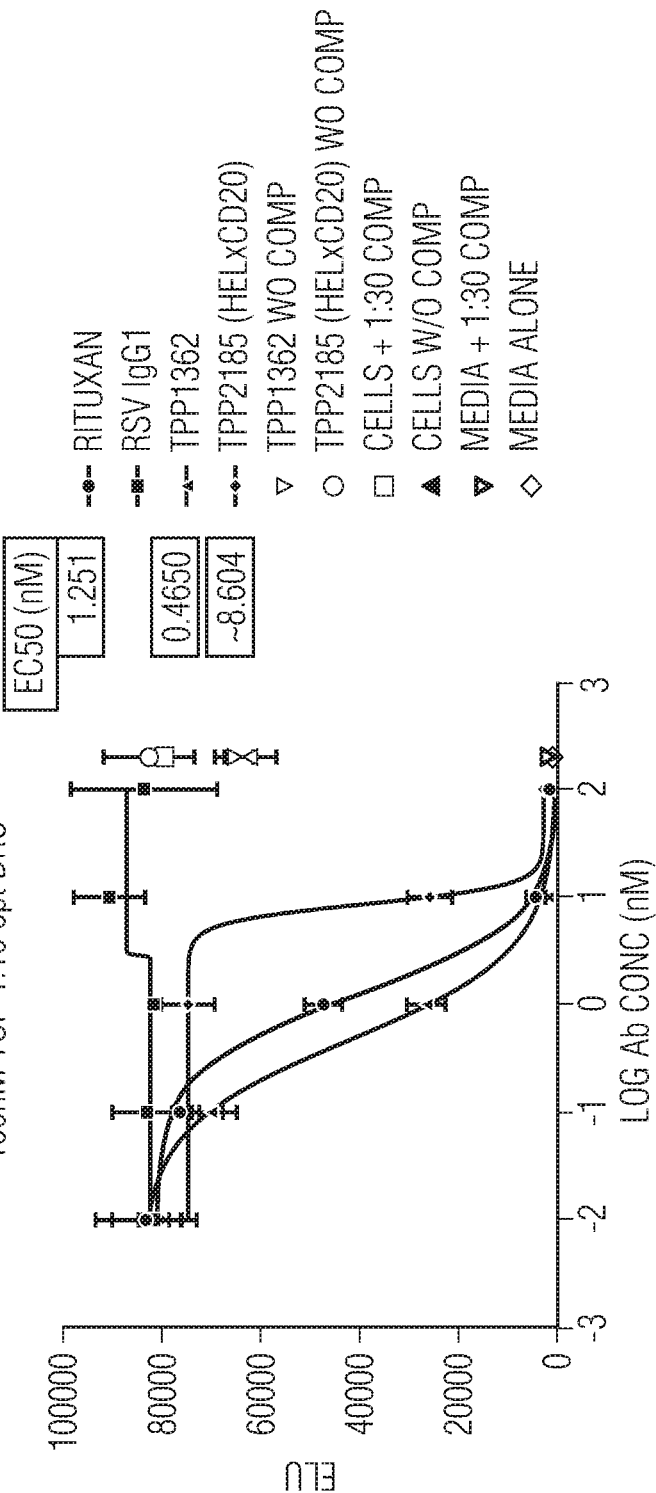

FIGS. 4A-4C show that example bispecific entities, CD47×CD20 IgG1 species described herein demonstrate CDC function. FIGS. 4A-4B are graphs that show CDC in view of antibody concentration. FIG. 4C is a table showing average EC50 values for TPP-1360, TPP-1362 and rituximab.

Figure 5A:
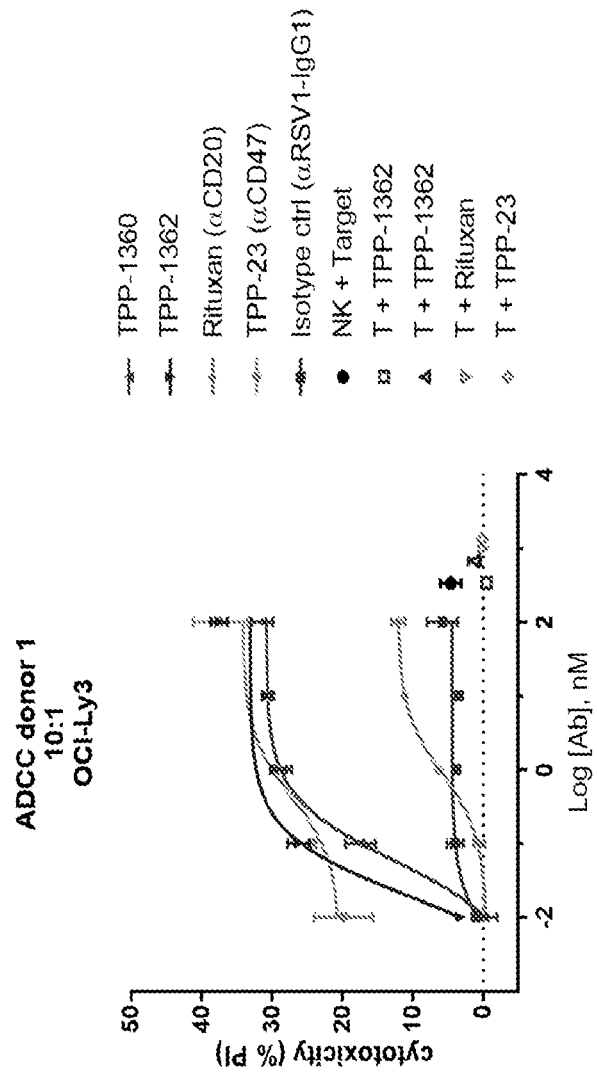
Figures 5B, 5C:
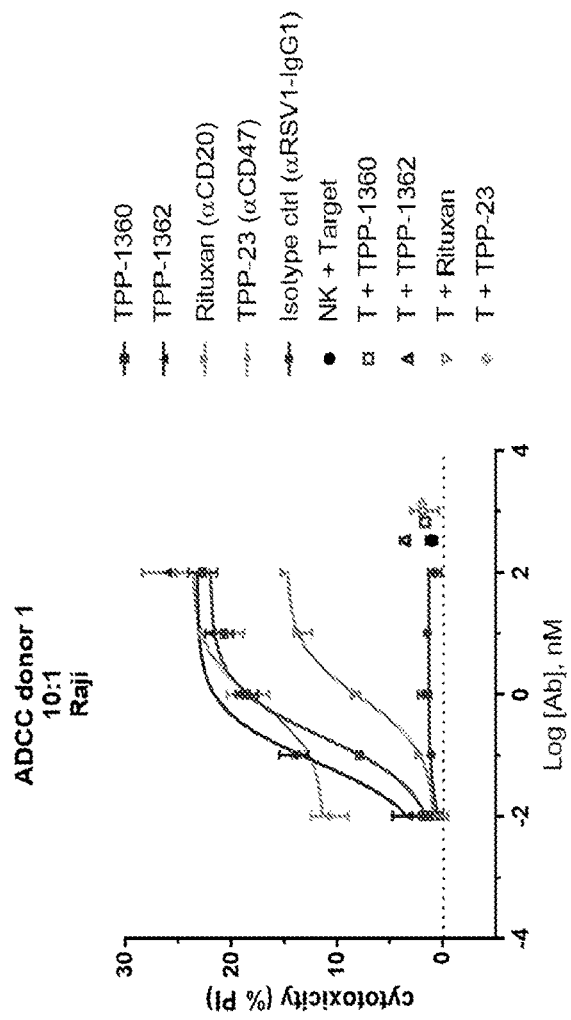

FIGS. 5A-5C show that example bispecific entities, CD47×CD20 IgG1 species described herein, demonstrate potent ADCC function in CD20 high NHL cells, i.e., significantly higher than rituximab. FIGS. 5A-5B are graphs that show cytotoxicity in view of antibody concentration. FIG. 5C is a table showing CD20/CD47 Ratio.

Figure 6:
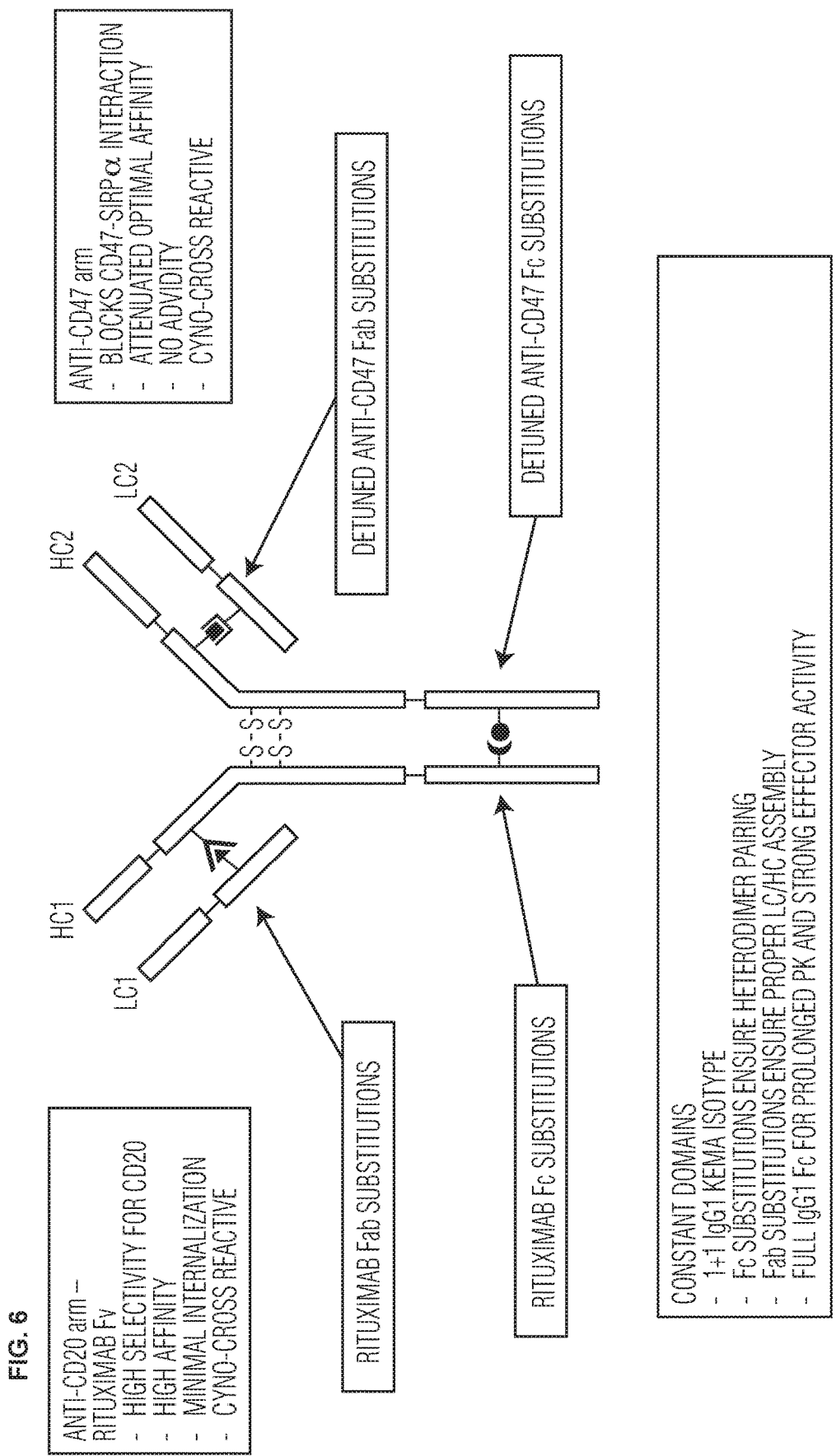

FIG. 6 illustrates example architecture of bispecific entities described herein as well as features of certain examples.

Figure 7:
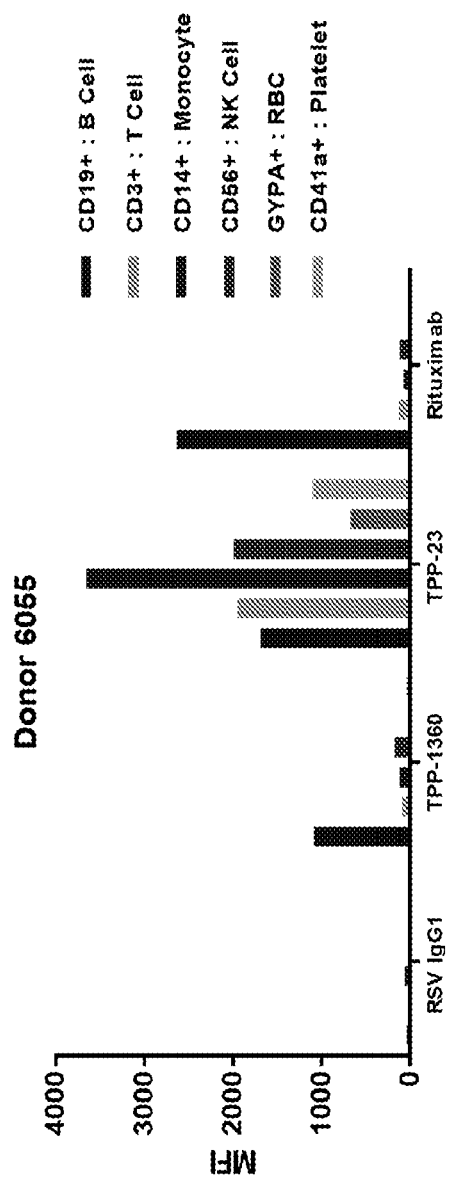

FIG. 7 shows an example species bispecific entity described herein, TPP-1360, that substantially shifted the binding signal to B-cells and rather weakly to T cells, monocytes, and NK cells, with minimal or no binding to platelets or red blood cells as compared to binding of TPP-23 (408_437 Fab (VL: SEQ ID NO:899; VH: SEQ ID NO:900) with IgG1), thereby illustrating selective binding to B-cells in human whole blood.

Figure 8:
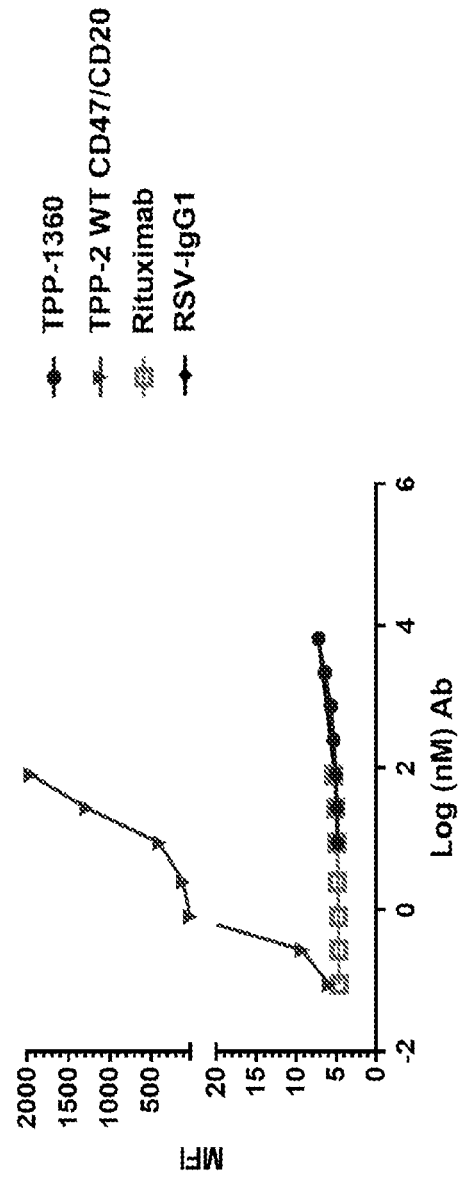

FIG. 8 illustrates an example species bispecific entity described herein, TPP-1360, that is demonstrated to selectively bind CD47$^+$/CD20+Raji Cells but not CD47$^+$/CD20$^-$ human red blood cells (RBCs).

Figure 9:
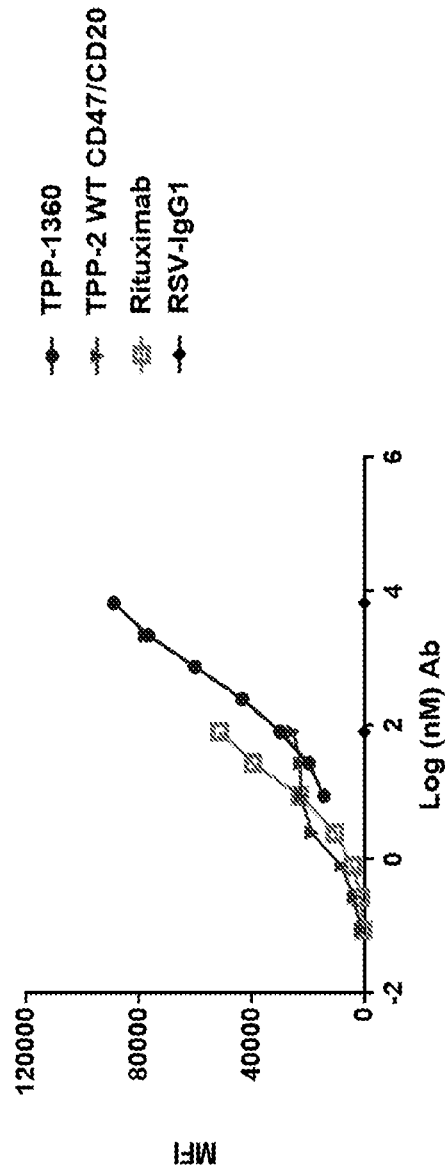

FIG. 9 shows that, in a co-culture of Raji cells and human RBCs, an example species bispecific entity described herein, TPP-1360, displayed dose-dependent binding to CD47$^+$/CD20$^+$ Raji cells but no binding to human RBCs, even at concentration as high as 1 mg/mL.

Figure 10:
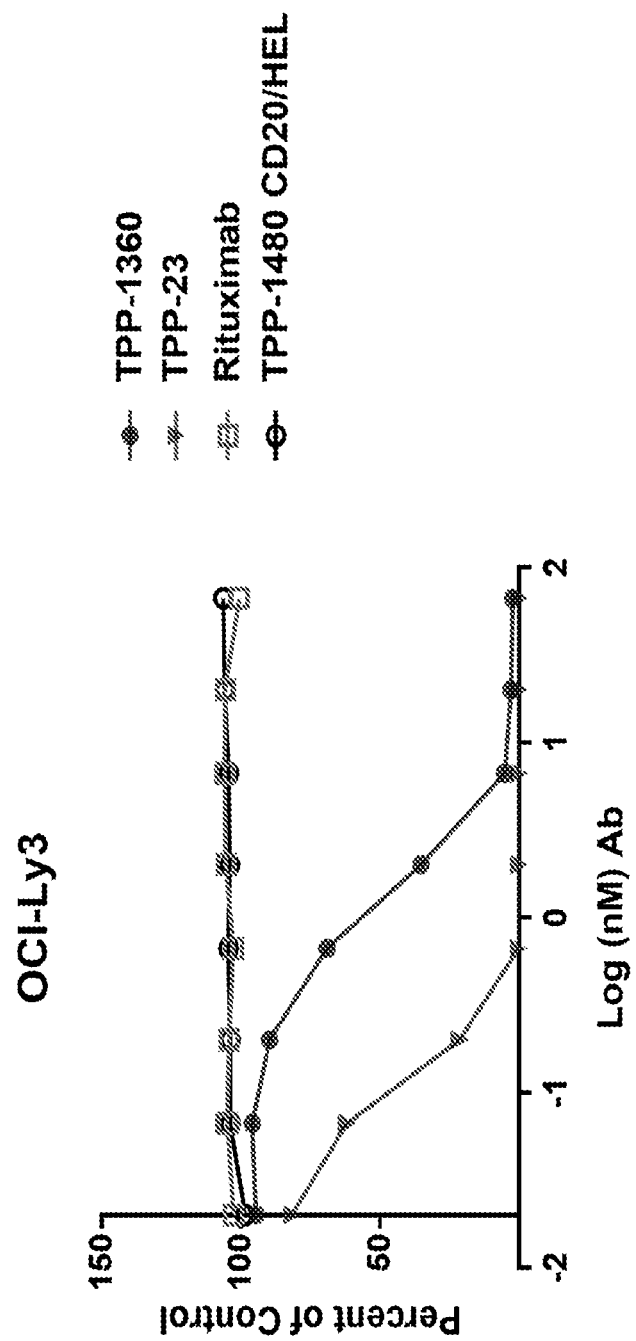

FIG. 10 illustrates that TPP-1360, for example, potently and completely blocked recombinant human SIRPα-Fc binding to human CD47 expressed on the surface of CD20$^+$/CD47$^+$ lymphoma cell line OCI-Ly3.

Figure 11:
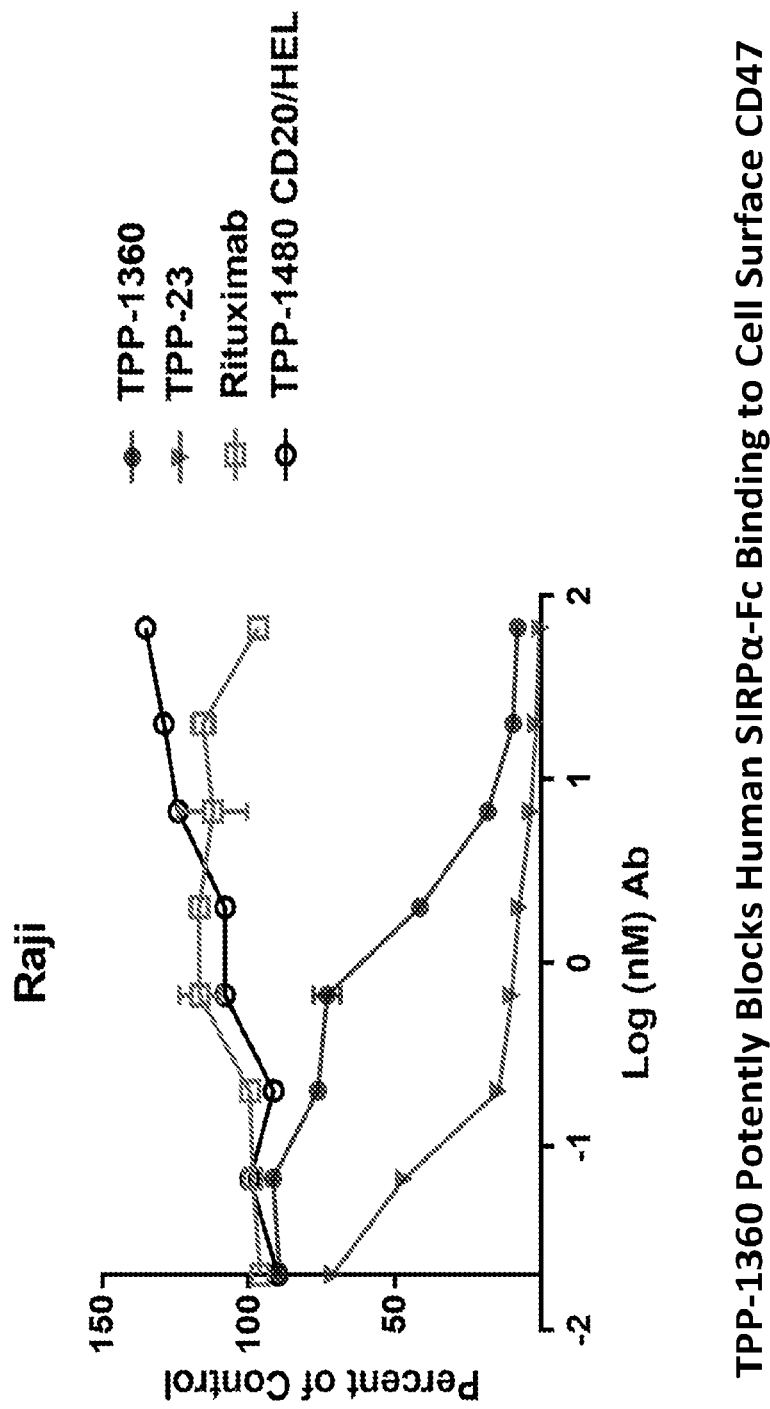

FIG. 11 illustrates that TPP-1360, for example, potently and completely blocked recombinant human SIRPα-Fc binding to human CD47 expressed on the surface of CD20$^+$/CD47$^+$ lymphoma cell line Raji.

Figure 12:
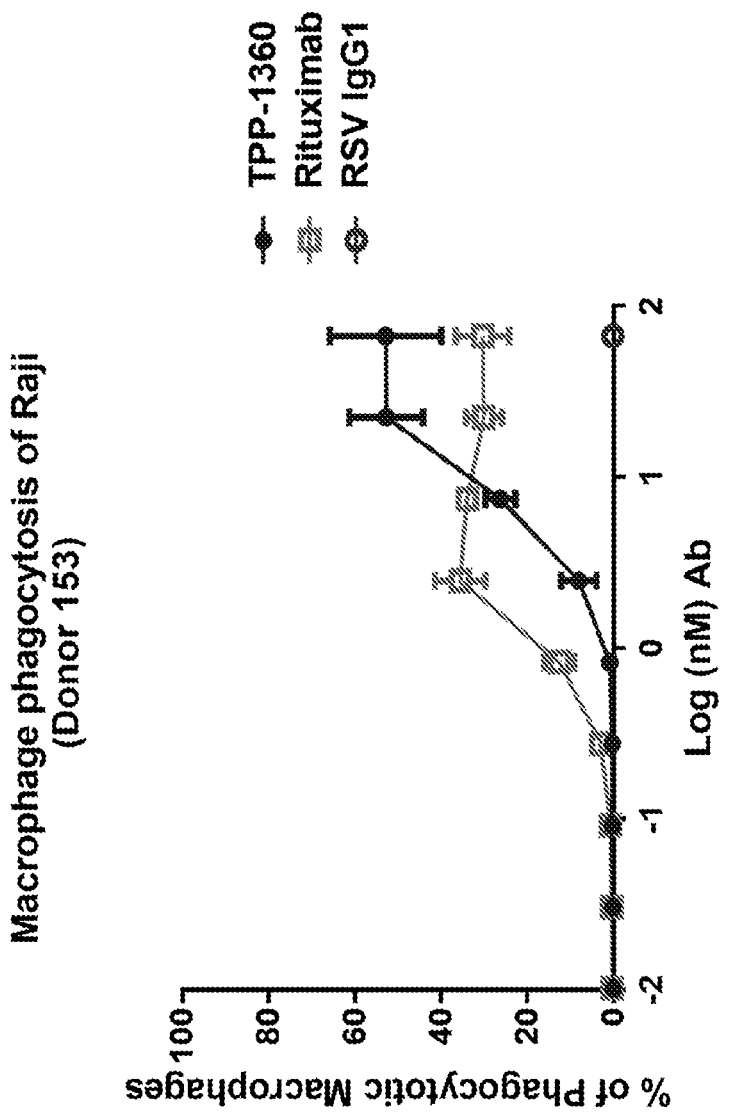

FIG. 12 illustrates that treatment with TPP-1360, for example, induced macrophage-mediated phagocytosis of the CD20$^+$ malignant B cell line, Raji.

Figure 13:
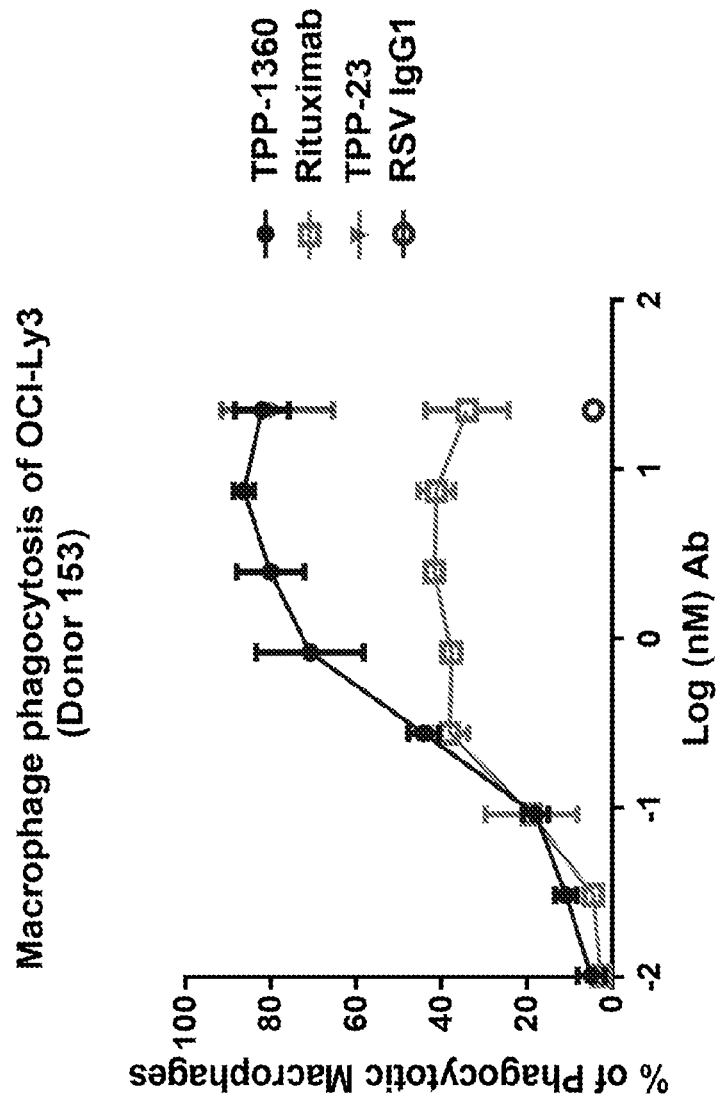

FIG. 13 illustrates that treatment with TPP-1360, for example, induced macrophage-mediated phagocytosis of the CD20$^+$ malignant B cell line, OCI-Ly3.

Figure 14:
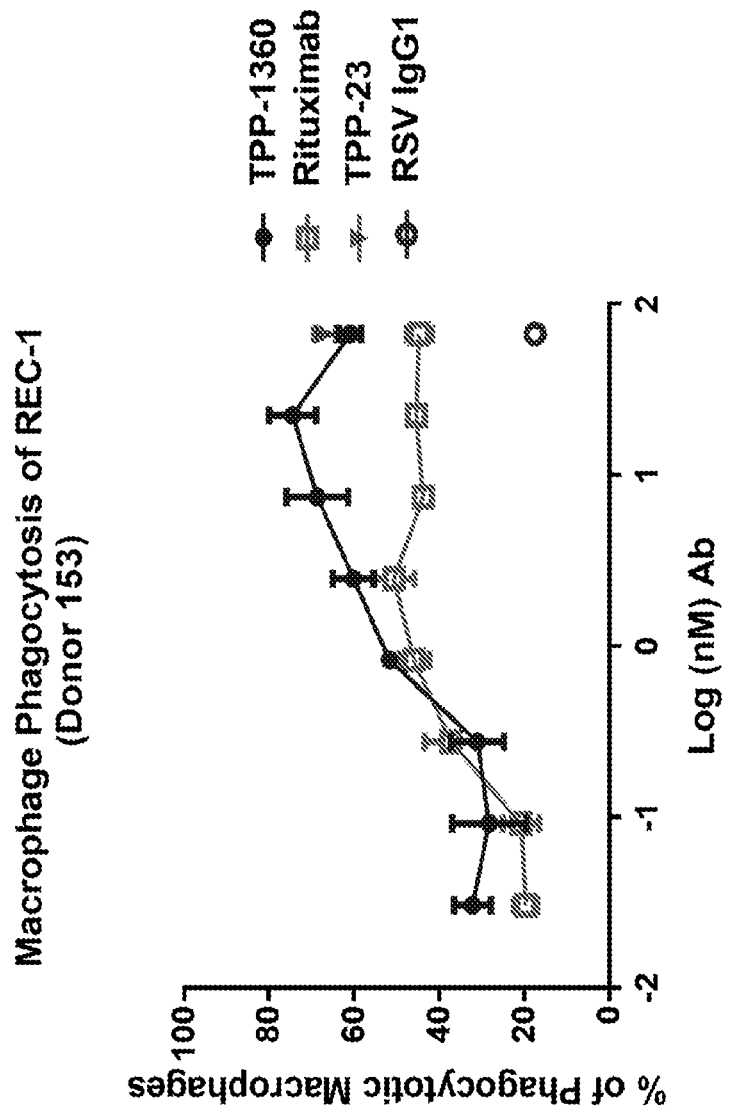

FIG. 14 illustrates that treatment with TPP-1360, for example, induced macrophage-mediated phagocytosis of the CD20$^+$ malignant B cell line, REC-1.

Figure 15:
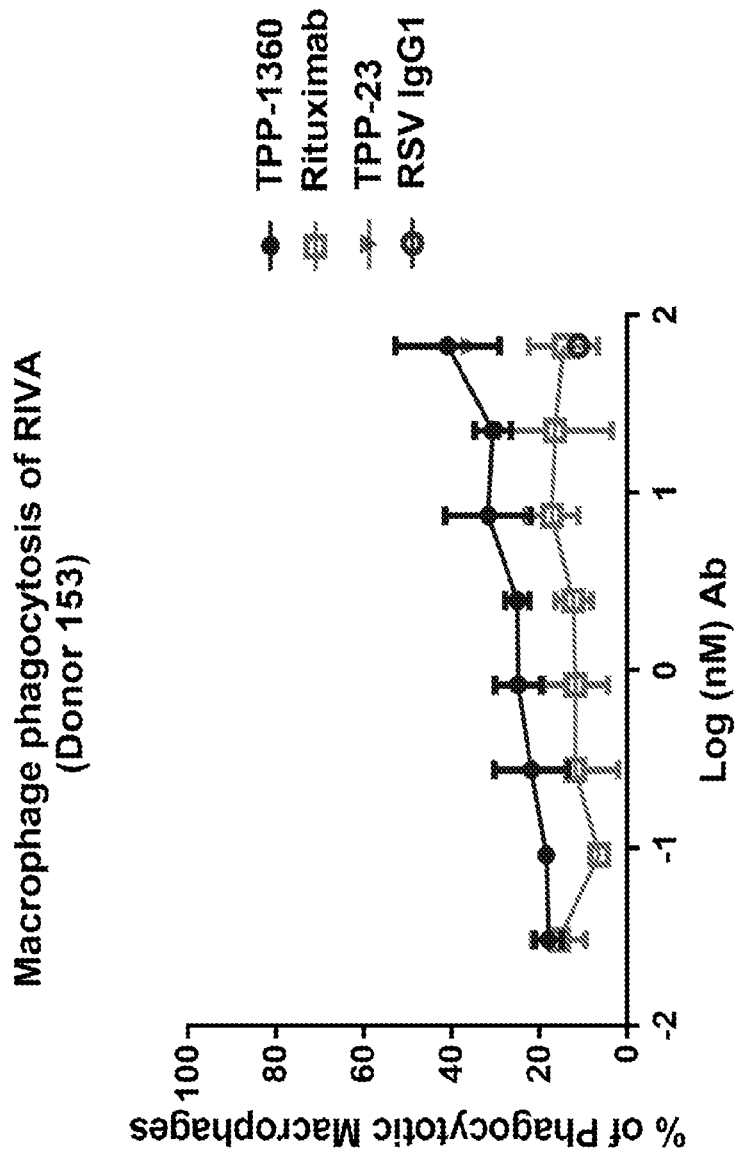

FIG. 15 illustrates that treatment with TPP-1360, for example, induced macrophage-mediated phagocytosis of the CD20$^+$ malignant B cell line, RIVA.

Figure 16:
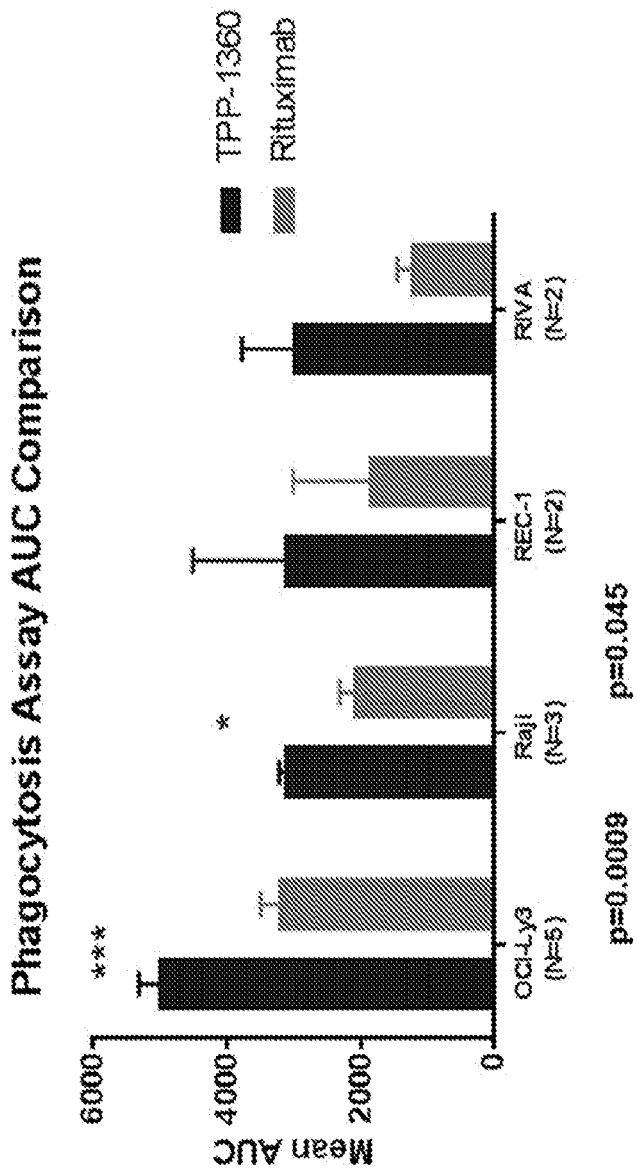

FIG. 16 shows that treatment with TPP-1360, for example, triggered significantly more efficient phagocytosis than rituximab in Raji and OCI-Ly3 cells, likely due to the concomitant blockade of the SIRPα-CD47 interaction and the engagement of activating receptors, such as FcγRs, by TPP-1360.

Figure 17:
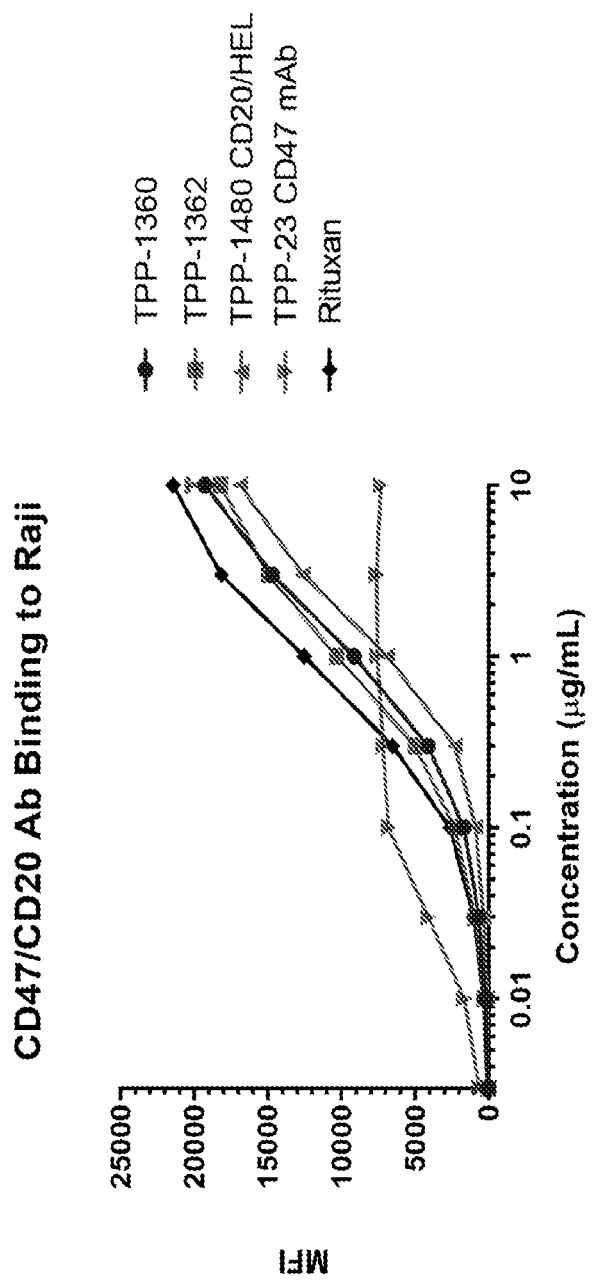

FIG. 17 shows binding of rituxan and bispecific antibodies such as TPP-1360, for example, to Raji cells (CD20+/CD47+) as measured by surface plasmon resonance (SPR).

Figure 18:
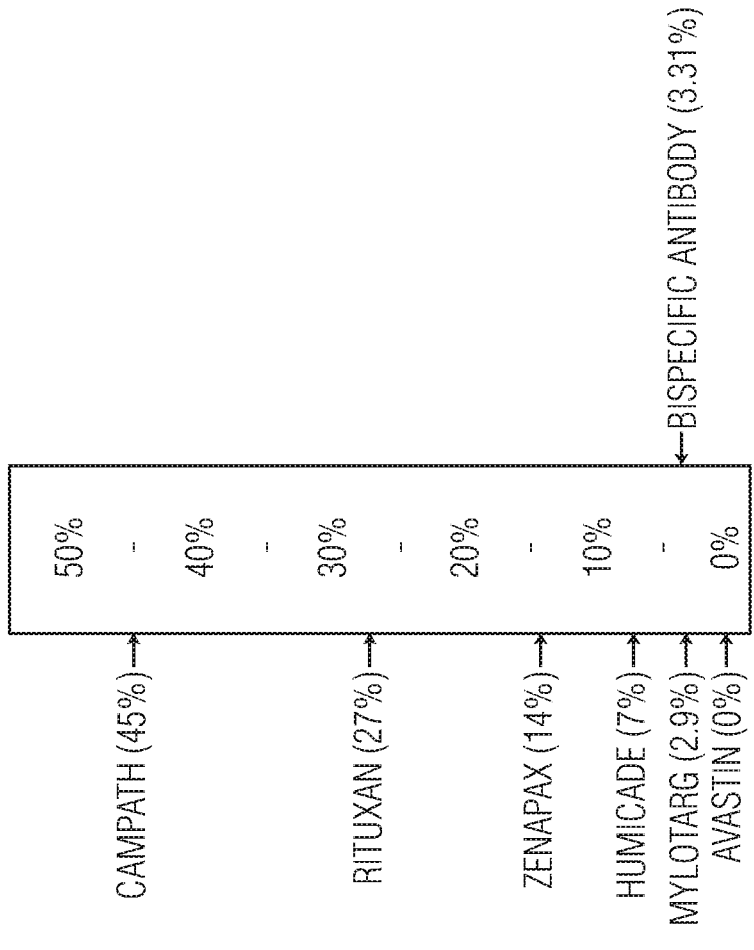

FIG. 18 shows the EpiMatrix antibody immunogenicity scale.

Figure 19:
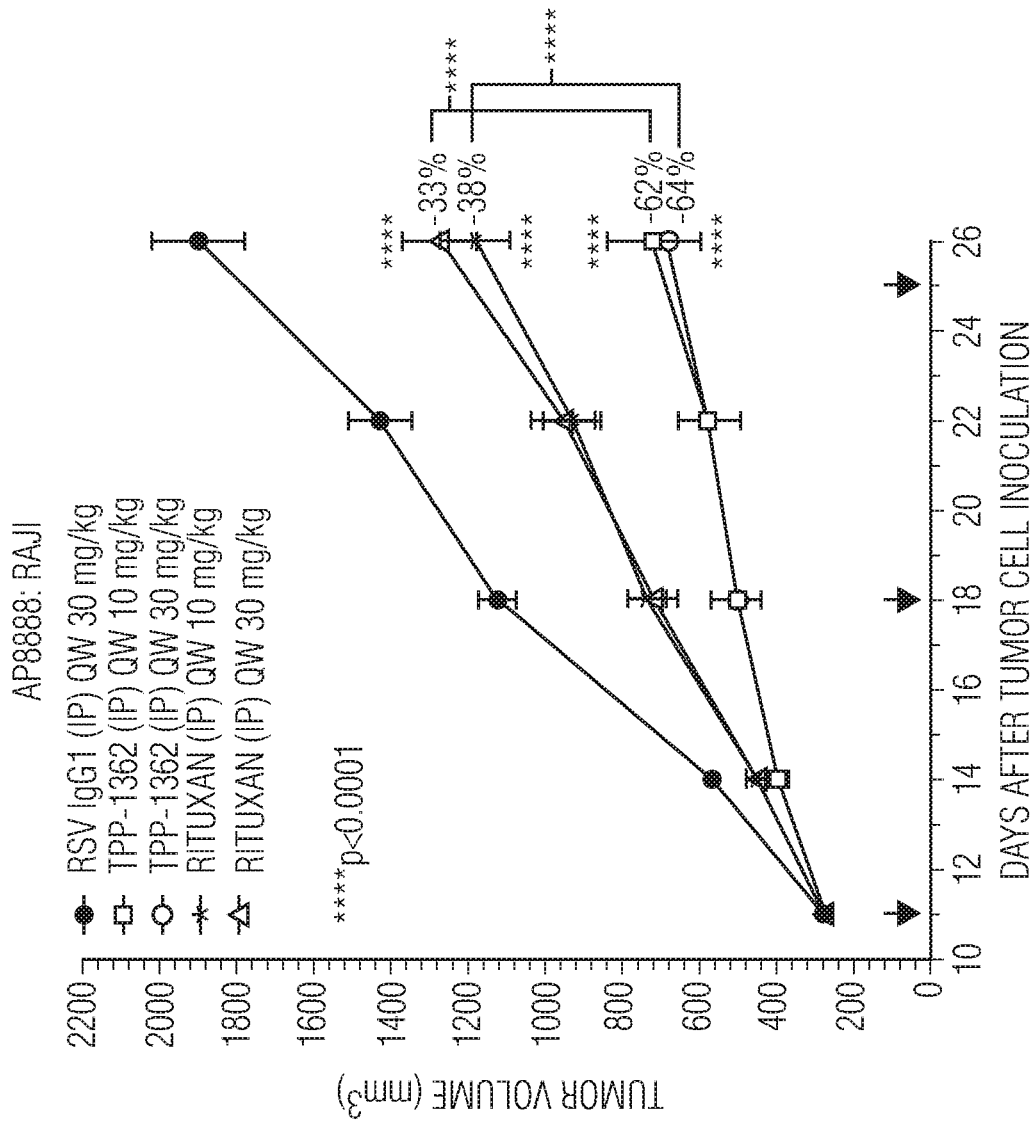

FIG. 19 shows treatment with TPP-1362 and rituxan in a Raji xenograft model.

Figure 20:
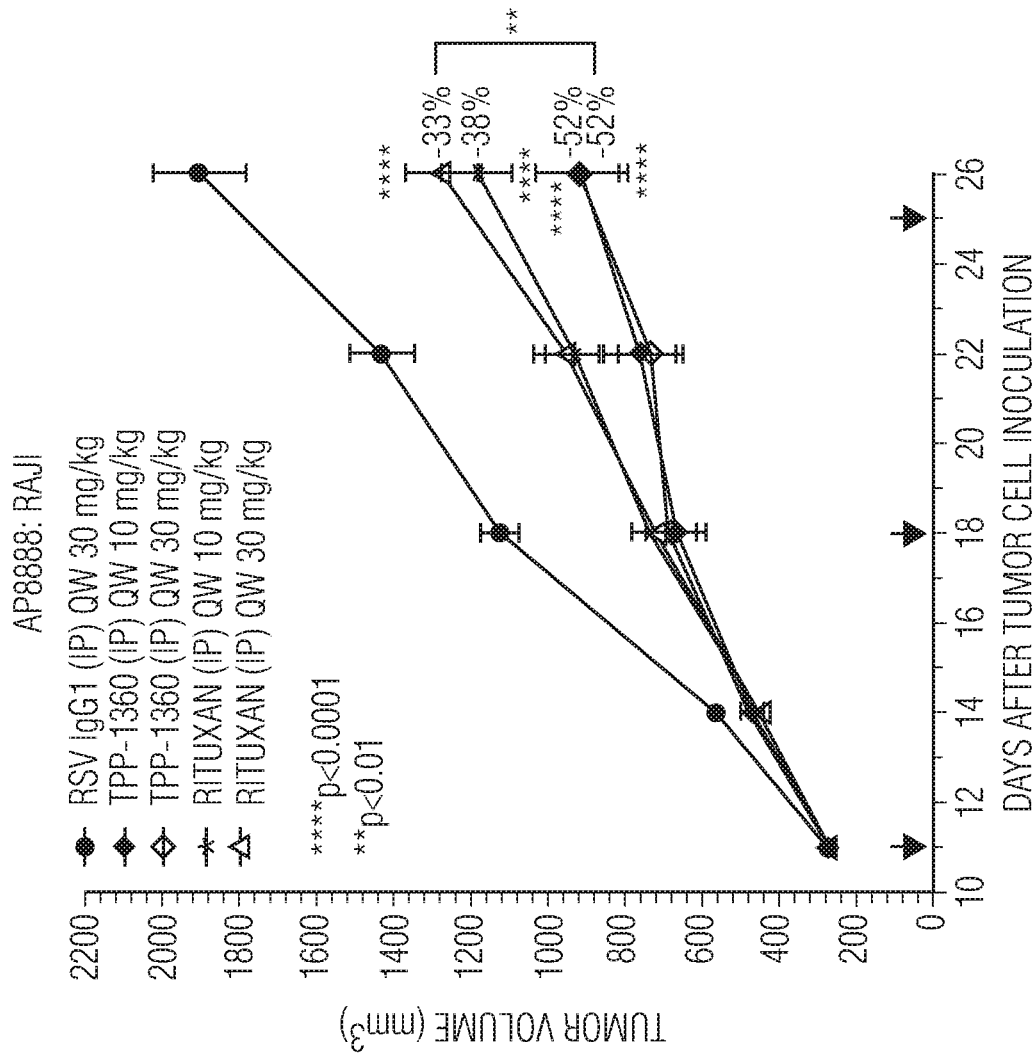

FIG. 20 shows treatment with TPP-1360 and rituxan in a Raji xenograft model.

Figure 21:
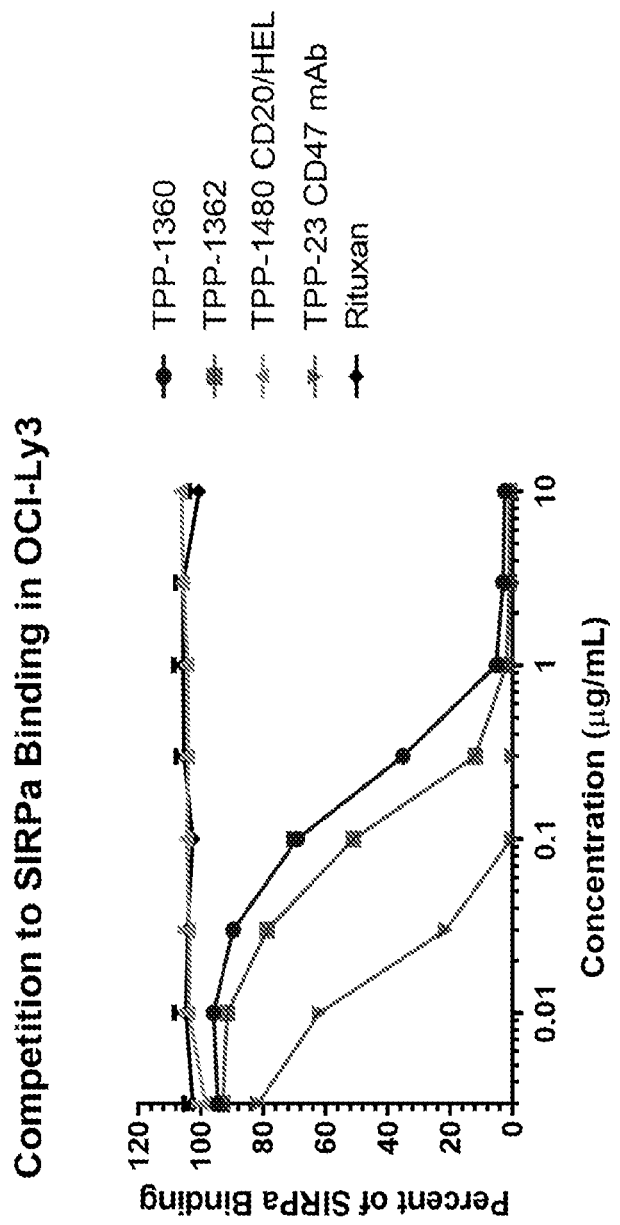

FIG. 21 illustrates that TPP-1360 and TPP-1362, for example, potently and completely blocked recombinant human SIRPα binding to human CD47 expressed on the surface of CD20$^+$/CD47 lymphoma cell line OCI-Ly3. Rituxan was found to have no effect on SIRPα binding.

DETAILED DESCRIPTION OF THE INVENTION

Unless defined otherwise, all technical and scientific terms used herein have the same meaning as is commonly understood by one of skill in the art to which this invention belongs. All publications and patents referred to herein are incorporated by reference.

As used herein, the articles "a" and "an" may refer to one or to more than one (e.g. to at least one) of the grammatical object of the article.

As used herein, "about" may generally refer to an acceptable degree of error for the quantity measured given the nature or precision of the measurements. Example degrees of error are within 5% of a given value or range of values.

Embodiments described herein as "comprising" one or more features may also be considered as disclosure of the corresponding embodiments "consisting of" and/or "consisting essentially of" such features.

As used herein "low affinity for CD47" refers to an affinity for CD47 that is below about 25 µM, for example from about 0.05 µM to about 25 µM when measured in vitro as Kd by SPR.

As used herein "high affinity for CD20" refers to an affinity for CD20 that is at or above about 0.4 nM, for example, from about 0.4 nM to about 12 nM. In some embodiments, "high affinity for CD20" refers to an affinity for CD20 that is from about 0.4 nM to about 5 nM. Bispecific entities described herein selectively bind CD47 on tumor cells and are substantially free of binding to CD47 in normal cells. As used herein "substantially free of binding to CD47" generally refers to binding less than 5% of CD47 on (CD20–/CD47+) normal cells. Bispecific entities described herein bind less than 2% of CD47 on (CD20–/CD47+) normal cells. See, Example 7. In other words entities described herein generally exhibit 95% or greater binding to (CD20+/CD47+) cells. Entities described herein exhibit 98% or greater binding to (CD20+/CD47+) cells.

The term "pharmaceutically acceptable" as used herein refers to approved by a regulatory agency of the Federal or a state government, or listed in the U.S. Pharmacopeia, European Pharmacopeia or other generally recognized pharmacopeia for use in animals, and more particularly in humans.

Concentrations, amounts, volumes, percentages and other numerical values may be presented herein in a range format. It is also to be understood that such range format is used merely for convenience and brevity and should be interpreted flexibly to include not only the numerical values explicitly recited as the limits of the range but also to include all the individual numerical values or sub-ranges encompassed within that range as if each numerical value and sub-range is explicitly recited.

Minor variations in the amino acid sequences of antibodies of the invention are contemplated as being encompassed by the present invention, providing that the variations in the amino acid sequence(s) maintain at least 75%, at least 80%, at least 90%, at least 95%, or at least 98 or 99% sequence homology or identity to the sequence of an antibody or antigen-binding fragment thereof as provided anywhere herein.

Antibodies of the invention may include variants in which amino acid residues from one species are substituted for the corresponding residue in another species, either at the conserved or non-conserved positions. In one embodiment, amino acid residues at non-conserved positions are substituted with conservative or non-conservative residues. In particular, conservative amino acid replacements are contemplated.

As used herein, a "conservative amino acid substitution" refers to one in which the amino acid residue is replaced with an amino acid residue having a similar side chain. Families of amino acid residues having similar side chains have been defined in the art, including basic side chains (e.g., lysine, arginine, or histidine), acidic side chains (e.g., aspartic acid or glutamic acid), uncharged polar side chains (e.g., glycine, asparagine, glutamine, serine, threonine, tyrosine, or cysteine), nonpolar side chains (e.g., alanine, valine, leucine, isoleucine, proline, phenylalanine, methionine, or tryptophan), beta-branched side chains (e.g., threonine, valine, isoleucine) and aromatic side chains (e.g., tyrosine, phenylalanine, tryptophan, or histidine). Thus, if an amino acid in a polypeptide is replaced with another amino acid from the same side chain family, the amino acid substitution is considered to be conservative. The inclusion of conservatively modified variants in an antibody of the invention does not exclude other forms of variant, for example polymorphic variants, interspecies homologs, and alleles.

As used herein, "non-conservative amino acid substitutions" include those in which (i) a residue having an electropositive side chain (e.g., arginine, histidine or lysine) is substituted for, or by, an electronegative residue (e.g., glutamate or aspartate), (ii) a hydrophilic residue (e.g., serine or threonine) is substituted for, or by, a hydrophobic residue (e.g., alanine, leucine, isoleucine, phenylalanine or valine), (iii) a cysteine or proline is substituted for, or by, any other residue, or (iv) a residue having a bulky hydrophobic or aromatic side chain (e.g., valine, histidine, isoleucine or tryptophan) is substituted for, or by, one having a smaller side chain (e.g., alanine or serine) or no side chain (e.g., glycine).

The terms "antibody" and "antibodies", as used herein, refers to conventional isotypes and monospecific formats as well as multivalent antibodies including but not limited to current bispecific entity formats known in the art as well as bispecific antibodies including but not limited to formats otherwise described herein.

A typical antibody comprises at least two "light chains" (LC) and two "heavy chains" (HC). The light chains and heavy chains of such antibodies are polypeptides consisting of several domains. Each heavy chain comprises a heavy chain variable region (abbreviated herein as "VH") and a heavy chain constant region (abbreviated herein as "CH"). The heavy chain constant region comprises the heavy chain constant domains CH1, CH2 and CH3 (antibody classes IgA, IgD, and IgG) and optionally the heavy chain constant domain CH4 (antibody classes IgE and IgM). Each light chain comprises a light chain variable domain (abbreviated herein as "VL") and a light chain constant domain (abbreviated herein as "CL"). The variable regions VH and VL can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. The "constant domains" of the heavy chain and of the light chain are not involved directly in binding of an antibody to a target, but exhibit various effector functions.

Binding between an antibody and its target antigen or epitope is mediated by the Complementarity Determining Regions (CDRs). The CDRs are regions of high sequence variability, located within the variable region of the antibody heavy chain and light chain, where they form the antigen-binding site. The CDRs are the main determinants of antigen specificity. Typically, the antibody heavy chain and light chain each comprise three CDRs which are arranged non-consecutively. The antibody heavy and light chain CDR3 regions play a particularly important role in the binding specificity/affinity of the antibodies according to the invention and therefore provide a further aspect of the invention.

Thus, the term "antigen binding fragment" as used herein incudes any naturally-occurring or artificially-constructed configuration of an antigen-binding polypeptide comprising one, two or three light chain CDRs, and/or one, two or three heavy chain CDRs, wherein the polypeptide is capable of binding to the antigen.

The sequence of a CDR may be identified by reference to any number system known in the art, for example, the Kabat system (Kabat, E. A., et al., Sequences of Proteins of Immunological Interest, 5th ed., Public Health Service, National Institutes of Health, Bethesda, MD (1991); the Chothia system (Chothia &, Lesk, "Canonical Structures for the Hypervariable Regions of Immunoglobulins," J. Mol. Biol. 196, 901-917 (1987)); or the IMGT system (Lefranc et al., "IMGT Unique Numbering for Immunoglobulin and Cell Receptor Variable Domains and Ig superfamily V-like domains," Dev. Comp. Immunol. 27, 55-77 (2003)). CDRs shown herein employ the boundaries, i.e., size, according to KABAT. Position numbering of antibody constant regions described and referred to herein are generally according to KABAT. However, numbering of anti-CD47 VL and VH regions described herein, i.e., antibody residue positions and substituted positions, begins with the N-terminal residue of each variable region, i.e., VL or VH, particularly with reference to SEQ ID NO:325 and SEQ ID NO:326, respectively.

"Bispecific entities described herein" generally refers to the functionally defined antibodies, bispecific elemental formats, elemental sequences, antibodies, and antibody species described herein.

The term "Fab portion" or "arm", as used herein, refers to an antigen-binding fragment of an antibody, i.e., a region of an antibody that binds an antigen. As used herein it comprises one variable domain of each of a light and heavy chain (VL/VH).

A "Fab' fragment" contains a single light chain and a single heavy chain but in addition to the CH1 and the VH, a "Fab' fragment" contains the region of the heavy chain between the CH1 and CH2 domains that is required for the formation of an inter-chain disulfide bond. Thus, two "Fab' fragments" can associate via the formation of a disulphide bond to form a F(ab')2 molecule.

A "F(ab')2 fragment" contains two light chains and two heavy chains. Each chain includes a portion of the constant region necessary for the formation of an inter-chain disulfide bond between two heavy chains.

An "Fv fragment" contains only the variable regions of the heavy and light chain. It contains no constant regions.

A "single-domain antibody" is an antibody fragment containing a single antibody domain unit (e.g., VH or VL).

A "single-chain Fv" ("scFv") is antibody fragment containing the VH and VL domain of an antibody, linked together to form a single chain. A polypeptide linker is commonly used to connect the VH and VL domains of the scFv.

A "tandem scFv", also known as a T and Ab', is a single-chain Fv molecule formed by covalent bonding of two scFvs in a tandem orientation with a flexible peptide linker.

A "bi-specific T cell engager" (BiTE') is a fusion protein consisting of two single-chain variable fragments (scFvs) on a single peptide chain. One of the scFvs binds to T cells via the CD3 receptor, and the other to a tumour cell antigen.

A "diabody" is a small bivalent and bispecific antibody fragment comprising a heavy (VH) chain variable domain connected to a light chain variable domain (VL) on the same polypeptide chain (VH-VL) connected by a peptide linker that is too short to allow pairing between the two domains on the same chain (Kipriyanov, Int. J. Cancer 77 (1998), 763-772). This forces pairing with the complementary domains of another chain and promotes the assembly of a dimeric molecule with two functional antigen binding sites.

A "DARPin" is a bispecific ankyrin repeat molecule. DARPins are derived from natural ankyrin proteins, which can be found in the human genome and are one of the most abundant types of binding proteins. A DARPin library module is defined by natural ankyrin repeat protein sequences, using 229 ankyrin repeats for the initial design and another 2200 for subsequent refinement. The modules serve as building blocks for the DARPin libraries. The library modules resemble human genome sequences. A DARPin is composed of 4 to 6 modules. Because each module is approx. 3.5 kDa, the size of an average DARPin is 16-21 kDa. Selection of binders is done by ribosome display, which is completely cell-free and is described in He M. and Taussig M J., Biochem Soc Trans. 2007, November; 35(Pt 5):962-5.

The terms "tumor" and "tumor cell" as used herein broadly refers to cancer cells including but not limited to cells undergoing aberrant proliferation, hematological oncology conditions, hematological malignancies, lymphoproliferative disorders, B-cell disorders, B-cell malignancies, and B-cell lymphoma.

IgG1 or IgG1 1+1 heterodimer format, as used herein, fundamentally refers to a whole IgG1 antibody composed of (i) one heavy chain (HC) and one light chain (LC), on one side, from one source, i.e., anti-CD47; and, one heavy chain (HC) and one light chain (LC), on the other side, from another source, e.g., anti-CD20. See, e.g., FIG. 2 and FIG. 6.

CD47

The value of cancer immunotherapy targeting the CD47/SIRPα axis is well-established. See, e.g., Weiskopf, K., et al., Eur J Cancer. 2017 May; 76:100; Feng, M., et al., Nat Rev Cancer. 2019 October; 19(10):568-586. Anti-CD47 approaches in the clinic have been be limited by the need for combination therapy, the tissue sink in targeting CD47 with a high-affinity binder, immunogenicity, and the observed hematologic toxicity with some of the clinical molecules (anemia, neutropenia, and/or thrombocytopenia).

CD47, while upregulated on tumor cells, is also ubiquitously expressed on all cells, including, at relatively high levels, NK cells, RBCs, and platelets. Monospecific agents targeting CD47 therefore tend to exhibit poor pharmacokinetic properties due to target-mediated drug disposition (TMDD) and side effects, including anemia and thrombocytopenia. Target-mediated drug disposition (TMDD) is the phenomenon in which a drug binds with high affinity to its pharmacological target site (such as a receptor) to such an extent that this affects its pharmacokinetic characteristics. Anti-CD47 IgG4 mAbs are generally required to reduce toxicity. Single anti-CD47, e.g., IgG1, agent activity thus tends to be limited.

Russ, A., et al., Blood Rev. 2018 November; 32(6):480 described a specific well-characterized IgG4 anti-CD47 antibody (CC-90002). See, particularly, WO2013119714 (U.S. Pat. No. 9,045,541).

Various amino acid substitutions in this antibody, designed to increase cell-free production and reduce immunogenicity, have been described. See WO2016109415 (US20170369572); WO2018009499 (US20190241654); and WO2018183182. CC-90002 is a high affinity IgG4 P/E anti-CD47 molecule that binds to CD47 expressed on disease and normal tissues.

Because CD47 is expressed widely on normal tissues as well as on tumor cells, however, a high-affinity anti-CD47 antibody may lead to undesirable toxicity. Provided herein, therefore, are bispecific antibodies comprising a CD47-binding domain that improves upon CC-90002 with respect to toxicity and efficacy. In particular, the bispecific entities described herein selectively and safely target tumor cells, with little to no binding to CD47 in peripheral tissues. The present invention is directed to an antibody comprising at least one Fab portion that binds CD47 and at least one Fab portion that binds CD20; wherein the Fab portion that binds CD47 exhibits low affinity for CD47 (e.g., Kd greater than 100 nM); and, wherein the Fab portion that binds CD20 exhibits high affinity for CD20 (e.g., Kd less than 5 nM); and, wherein the bispecific antibody selectively binds CD47 in tumor cells and is substantially free of binding to CD47 in normal cells.

CC-90002 is provided as a reference parental sequence and as a source of anti-CD47 elements for construction of some of the bispecific entities described herein. CC-90002 VL CDRs are SEQ ID NO:347 (CDRL1), SEQ ID NO:348 (CDRL2), and SEQ ID NO:349 (CDRL3). CC-90002 VH CDRs are SEQ ID NO:350 (CDRH1), SEQ ID NO:351 (CDRH2), and SEQ ID NO:352 (CDRH3). CC-90002 VL (SEQ ID NO:325) and VH (SEQ ID NO:326) are also provided for reference. CC-90002 VL fused to a native IgG1 LC constant region to form a whole LC for reference is provided as CC-90002 WHOLE LC/IgG1 (SEQ ID NO:327). CC-90002 VH fused to a native IgG1 HC constant region to form a whole HC for reference is provided as CC-90002 WHOLE HC/IgG1 (SEQ ID NO:328).

Both VH and VL regions of CC-90002 were engineered to reduce immunogenicity, while retaining functionality for employment in bispecific entities described herein.

Anti-CD47 arms for the bispecific entities described herein were also derived from CL-4033, as described in Example 2 and elsewhere herein.

Bispecific entities described and exemplified herein, for example, are demonstrated to overcome the challenges of single agent anti-CD47 mAb therapy. Due to the detuned affinity for CD47, CD47×CD20 bispecific entities described and provided herein bind preferentially to CD20⁺ Tumor Associated Antigen (TAA) cells, thereby reducing the sink effect mediated by CD47⁺ cells and on-target off-tumor toxicity. Together, the cellular potency, in vivo efficacy, and safety data indicate that CD47×CD20 bispecifics described and exemplified herein offer a unique option as single agents for CD20-positive B cell malignancy, for example.

Figure 1:
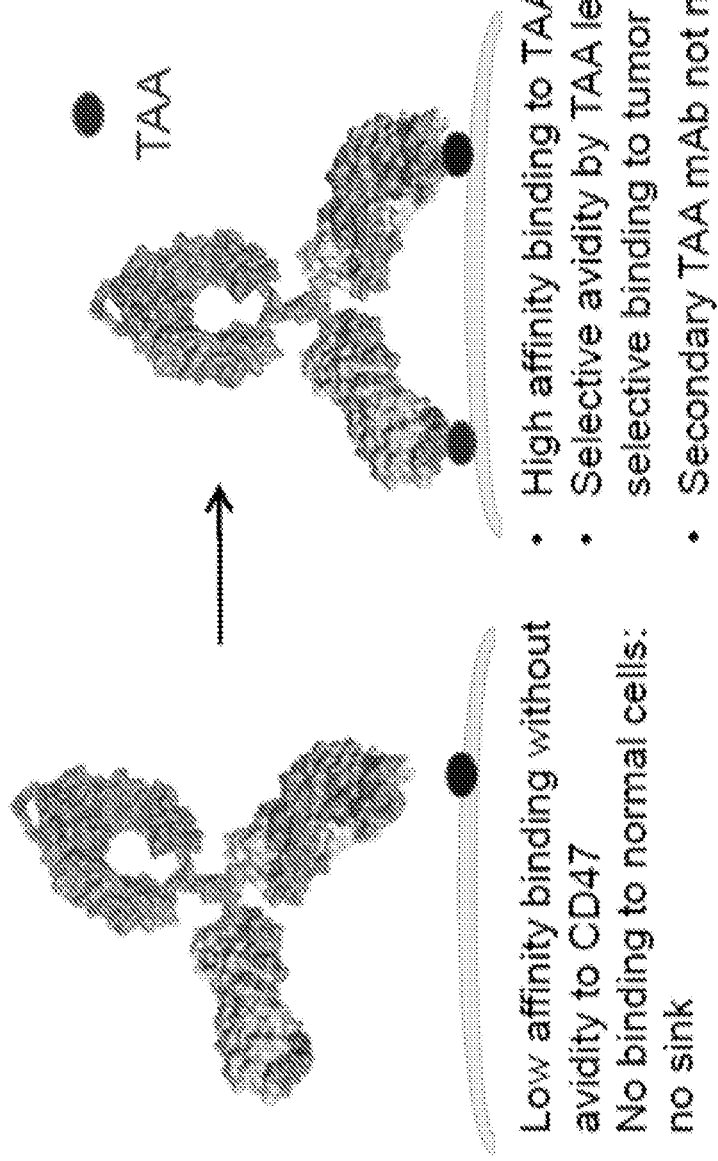
FIG. 1 is a schematic illustration of certain attributes of bispecific entities described herein engineered to overcome the challenge of ubiquitous CD47 expression including low affinity binding without avidity to CD47; minimal binding to normal cells, i.e., no tissue sink; high affinity selective avidity binding to CD20 which results in selective binding to tumor cells.

FIG. 1 is a schematic illustration of certain attributes of bispecific entities described herein engineered to overcome the challenge of ubiquitous CD47 expression including low affinity binding without avidity to CD47; minimal binding to normal cells, i.e., no tissue sink; high affinity selective avidity binding to the Tumor Associated Antigen (TAA) CD20; which results in selective binding to tumor cells.

CD47×CD20 bispecifics provided herein may comprise a CD20 binding domain from any high-affinity CD20 binder. Rituximab LC (SEQ ID NO:329) and HC (SEQ ID NO:330) are preferred sources of anti-CD20 elements for construction of bispecific entities described herein. In certain embodiments, the bispecific antibodies provided herein comprise one or both of the rituximab VL (SEQ ID NO:323) and VH (SEQ ID NO:324), or comprise Rituximab VL CDRs: SEQ ID NO:353 (CDRL1), SEQ ID NO:354 (CDRL2), and SEQ ID NO:355 (CDRL3); and Rituximab VH CDRs: SEQ ID NO:356 (CDRH1), SEQ ID NO:357 (CDRH2), and SEQ ID NO:358 (CDRH3), respectively. Anti-CD20 IgG1 LC and HC constant regions as otherwise described herein are fused to the carboxy termini of rituximab VL (SEQ ID NO:323) and rituximab VH (SEQ ID NO:324), respectively. Anti-CD20 LC (SEQ ID NO:331) is preferred for employment in construction of bispecific entities of the present invention. Anti-CD20 HC (SEQ ID NO:332) is preferred for employment in construction of bispecific entities of the present invention.

Example bispecific entities described herein selectively and safely target CD20+ tumor cells, with substantially no binding to CD47 in peripheral tissues, RBCs, and platelets, providing prolonged half-life with lower toxicity and wherein the antibody mediates complement-dependent cytotoxicity (CDC) of the tumor cells.

Bispecific Entities are Preferably of the IgG1 1+1 Heterodimer Format.

In certain embodiments, the bispecific antibodies provided herein comprise two antigen binding arms, which are covalently connected to form a single entity. IgG bispecific antibodies that employ two Fab domains require careful consideration with regards to expression and purification strategy to ensure proper assembly of the desired product. Efforts can be taken at the genetic level to bias the expression of the desired bispecific antibody. For instance, substitutions in the CH3 domains of the IgG Fc to drive heterodimerization of the Fc have been described. Further, knob-in hole strategy utilizes steric hindrance to create complementary asymmetric molecular faces between two different Fc CH3 domains. Other strategies known in the art employ electrostatic complementarity to drive specificity. Alternatively, wild-type IgG scaffolds can be used and the resulting combination of products can be separated during to protein purification to isolate the desired product.

Preferred bispecific antibodies of the present invention are fundamentally native human IgG1 antibodies composed of, (A) one anti-CD47 IgG1 (monomeric) portion which contains one entire light chain (LC) and one entire heavy chain (HC), as well as (B) one anti-CD20 IgG1 (monomeric) portion which contains one entire light chain (LC) and one entire heavy chain (HC). The two monomers form a conventional dimeric IgG1 antibody wherein one arm (Fab₁) provides for attenuated binding of CD47 while the other arm (Fab₂) provides for affinity binding and avidity for CD20. FIG. 2 and FIG. 6 illustrate CD47×CD20 example architecture described herein and example protein engineering features.

Preferred monomeric elements of the IgG1 1+1 heterodimers described herein each contain certain subsequences within the LC and HC constant regions that reduce homodimer formation during production of the IgG1 1+1 heterodimer format. In one embodiment, an anti-CD47 LC constant region that ensures proper LC/HC pairing during production comprises SEQ ID NO:340. In another embodiment, an anti-CD47 HC constant region that ensures Fc heterodimer formation during production comprise SEQ ID NO:342. Preferred anti-CD20 LC constant region to ensure proper LC/HC pairing during production comprise SEQ ID NO:344. Preferred anti-CD20 HC constant region to ensure Fc heterodimer formation during production comprise SEQ ID NO:346. An example anti-CD47 LC constant region to ensure proper LC/HC pairing during production is SEQ ID NO:339. An example anti-CD47 HC constant region to ensure Fc heterodimer formation during production is SEQ ID NO:341. An example anti-CD20 LC constant region to ensure proper LC/HC pairing during production is SEQ ID NO:343. An example anti-CD20 HC constant region to ensure Fc heterodimer formation during production is SEQ ID NO:345.

Preferred IgG1 Constant Regions for Employment with 161 Fabs Described Herein in IgG1 1+1 Heterodimer Format Wherein the Fabs Provide for Attenuated Binding of CD47 are LC Constant Region SEQ ID NO:339 and HC Constant Region SEQ ID NO:341.

Provided is an anti-CD47 IgG1 LC Constant Region comprising substitutions Q124E, L135W, Q160E, and T180E ensure proper LC/HC pairing during production of the IgG1 1+1 heterodimer format, as compared to CC-90002.

Further provided herein is a preferred anti-CD47 IgG1 LC Constant Region (SEQ ID NO:339). In certain embodiments, e.g., certain embodiments of the bispecific antibodies provided herein, an anti-CD47 VL region provided herein is fused to the amino terminus of SEQ ID NO:339. SEQ ID NO:340 is internal to SEQ ID NO:339. SEQ ID NO: 339 and SEQ ID NO: 440 comprise substitutions Q124E, L135W, Q160E, and T180E, that ensure proper LC/HC pairing during production of the IgG1 1+1 heterodimer format.

Provided is an anti-CD47 IgG1 HC Constant Region comprising substitutions Q179K, T371V, T389L, K420L, and T422W to ensure proper LC/HC pairing and Fc heterodimer formation during production of the IgG1 1+1 heterodimer format.

Further provided herein is a preferred anti-CD47 IgG1 HC Constant Region (SEQ ID NO:341). In certain embodiments, e.g., certain embodiments of the bispecific antibodies provided herein, an anti-CD47 VH region provided herein is fused to the amino terminus of SEQ ID NO:341. SEQ ID NO:342 is internal to SEQ ID NO:341. SEQ ID NO: 341 and SEQ ID NO: 342 comprise substitutions Q179K, T371V, T389L, K420L, and T422W to ensure Fc heterodimer formation during production of the IgG1 1+1 heterodimer format.

Provided is an anti-CD20 IgG1 LC Constant Region comprising substitutions F116A, Q124R, L135V, T178R that ensure proper LC/HC pairing during production of the IgG1 1+1 heterodimer format, as compared to rituximab.

Further provided herein is a preferred anti-CD20 IgG1 LC Constant Region (SEQ ID NO:343). In certain embodiments, e.g., certain embodiments of the bispecific antibodies provided herein, an anti-CD20 VL region provided herein is fused to the amino terminus of SEQ ID NO:343. SEQ ID NO:344 is internal to SEQ ID NO:343. SEQ ID NO:343 and SEQ ID NO:344 comprise substitutions F116A, Q124R, L135V, and T178R that reduce homodimer formation during production of the IgG1 1+1 heterodimer format.

Provided is an anti-CD20 IgG1 HC Constant Region comprising substitutions A139W, L143E, K145T, Q179E, T371V, L372Y, F436A, and Y438V that ensure Fc heterodimer formation during production of the IgG1 1+1 heterodimer format, as compared to rituximab.

Further provided herein is a preferred anti-CD20 IgG1 HC Constant Region (SEQ ID NO:345). In certain embodiments, e.g., certain embodiments of the bispecific antibodies provided herein, an anti-CD20 VH region provided herein is fused to the amino terminus of SEQ ID NO:345. SEQ ID NO:346 is internal to SEQ ID NO:345. SEQ ID NO:345 and SEQ ID NO:346 comprise substitutions A139W, L143E, K145T, Q179E, T371V, L372Y, F436A, and Y438V that reduce homodimer formation during production of the IgG1 1+1 heterodimer format.

CD47×CD20 Bispecifics

A CD47×CD20 bispecific program was initiated to identify therapeutic antibodies that are able to block human CD47 binding to SIRPα only on CD20 expressing cells. Examples resulting from that project and provided herein bind with high affinity to CD20 while exhibiting a detuned affinity to CD47. Once bound to CD20 on tumor cells the antibodies potently block CD47-SIRPα interaction and co-engage activating receptors FcγRs on effector cells through IgG1 Fc, resulting in activation of macrophage mediated phagocytosis and natural killer (NK) cell mediated cytotoxicity against tumor cells.

I. Bispecific Antibodies Comprising Anti-CD47 Derived from CC-90002

CD47 Epitope Mapping and CC-90002

The anti-CD47 epitope was determined by solving the crystal structure of a non-detuned parental version of (CC-90002 (408_437) Fab (CC-90002 VL: SEQ ID NO:899; CC-90002 VH: SEQ ID NO:900) in complex with the human CD47 extracellular domain at 2.4 Å resolution. All three light chain (LC) CDRs (SEQ ID NO:347, SEQ ID NO:348, SEQ ID NO:349) and the heavy chain (HC) CDR2 (SEQ ID NO:351) and HC CDR3 (SEQ ID NO:352) participate in binding to a large surface area of the CD47 ECD. The HC CDRs make multiple contacts to the KGRD loop of CD47 and the LC CDRs overlap with the SIRPα binding site, which explains the ability of CC-90002 and bispecific entities described herein to block SIRPα binding.

CD47×CD20 bispecific entities described herein are designed to promote CD20-restricted blockade of the CD47-SIRPα "don't eat me" signal on cancer cells that express both CD20 and CD47, while sparing CD47$^+$/CD20$^-$ normal cells. Multiple steps of protein engineering led to the anti-CD47 Fabs of the bispecific entities described herein. (1) Protein engineering was employed on both VH and VL chains of CC-90002 to reduce immunogenicity, while retaining functionality; and, (2) Protein engineering was also employed to detune CC-90002. IgG1 bispecific antibodies targeting CD47 and CD20 with reduced affinity to CD47, described and exemplified herein, 1) retain efficacy in mediating anti-tumor function by targeting the CD47-SIRPα interaction and engaging activating receptors FcγRs; 2) minimize target-mediated sink effects and toxicity observed with anti-CD47 therapeutics; 3) incorporate CD47 and CD20 engagement in a single molecule avoiding the need for combination therapy with 2 monoclonal antibodies.

Protein Design

A crystal structure of the effector antigen CD47 was bound to a high affinity anti-CD47 Fab (CC-90002 (408_437 VL: SEQ ID NO:899; 408_437 VH: SEQ ID NO:900)) to guide the construction of an in silico library of Fab variants predicted to have a range of lower affinities, good stability, and low immunogenicity. Variants from this library were expressed as IgG1 bispecifics with a high affinity anti-CD20 Fab (rituximab (VL: SEQ ID NO:323; CC-90002 VH: SEQ ID NO:324)).

The resulting 143 physical constructs were screened for selectivity and potency using cell-based assays for CD47 binding and SIRPα blocking to identify those variants that effectively bound to the effector antigen, CD47, on target cells co-expressing the selectivity antigen, CD20, but which bound minimally to a non-target cell line that expressed only the effector antigen, CD47.

Example anti-CD47 whole LC and HC, LC and HC constant regions, VL and VH regions, and CDR sequences are provided and otherwise described herein that have substantially reduced binding affinity for CD47 and reduced immunogenicity as compared to CC-90002, including but not limited to the IgG1 isotype. IgG1 1+1 heterodimer format is preferred, as described infra, comprising (A) one anti-CD47 IgG1 (monomeric) portion which contains one entire light chain (LC) and one entire heavy chain (HC), as well as (B) one anti-CD20 IgG1 (monomeric) portion which contains one entire light chain (LC) and one entire heavy chain (HC).

Antibodies of the present invention comprise VL and VH amino acid sequences derived from CC-90002, i.e., SEQ ID NO:325 and SEQ ID NO:326, respectively, wherein the binding affinity for CD47 is substantially attenuated, i.e., Fab portion that binds CD47 exhibits low affinity. A range of affinities to CD47 from the screen of detuned anti-CD47 binders described herein were found to have dramatically reduced binding to non-target cells and yet were still able to effectively bind to CD47 in an avid manner when recruited to the surface of the target cell after binding to CD20. Initial detuned CD47×CD20 bispecific leads achieved this selectivity with affinities that ranged from about 0.5 µM to about 2.5 µM. FIGS. 3A-3C. TPP-1360, for example, was measured to have an affinity for human CD47 ECD of 1.7 µM Kd, which reflects about 350× decrease in affinity relative to the parental anti-CD47 binder. TPP-1362 was measured to have an affinity for human CD47 ECD of 0.796 µM Kd, which reflects ~150× decrease in affinity relative to the parental anti-CD47 binder. Detuned CD47×CD20 bispecific entitied described herein exhibit selectivity with affinities that range from about 0.2 µM to about 4 µM.

Bispecific entities described herein selectively bind CD47 on CD20 expressing tumor cells and are substantially free of binding to CD47 in normal cells. The ratio of binding to Raji (CD47+CD20+) vs human RBC in the co-culture binding assay for bispecific entities described herein is about 6000 fold, for example. The ratio of binding to human B cells (CD47+CD20+) vs human RBC for bispecific entities described herein is about 700 fold, for example. The level of selection of bispecific entities described herein exhibit selection in the range from about 400 to about 8,000 fold depending upon the expression level of CD20 and CD47 on tumor cells and normal cells. Accordingly, assuming a fixed level of CD47 expression, as CD20 levels increase bispecific entitied described herein exhibit increased selectivity and potency.

Example antibodies of the present invention also comprise VL and VH regions derived from CC-90002, i.e., SEQ ID NO:325 and SEQ ID NO:326, respectively, wherein the VL, VH, or both comprise one or more amino acid substitutions that substantially reduce the immunogenicity of the resulting antibody. Example antibodies of the present invention comprise VL and VH regions derived from CC-90002, i.e., SEQ ID NO:325 and SEQ ID NO:326, respectively, wherein the VL, VH, or both sequences comprise one or more amino acid substitutions that reduce the binding affinity of the resulting antibody for CD47 and substantially reduced the immunogenicity of the resulting antibody.

Accordingly, preferred antibodies derived from CC-90002 described herein exhibit 1-7 amino acid substitutions relative to VL SEQ ID NO:325; and, 1-11 amino acid substitutions relative to VH SEQ ID NO:326.

Further contemplated and otherwise functionally described herein are antibodies derived from CC-90002 that exhibit 8 amino acid substitutions relative to VL SEQ ID NO:325.

Further contemplated and otherwise functionally described herein are antibodies derived from CC-90002 that exhibit 9 amino acid substitutions relative to VL SEQ ID NO:325. Further contemplated and otherwise functionally described herein are antibodies derived from CC-90002 that exhibit 10 amino acid substitutions relative to VL SEQ ID NO:325.

Further contemplated and otherwise functionally described herein are antibodies derived from CC-90002 that exhibit 12 amino acid substitutions relative to VH SEQ ID NO:326. Further contemplated and otherwise functionally described herein are antibodies derived from CC-90002 that exhibit 13 amino acid substitutions relative to VH SEQ ID NO:326. Further contemplated and otherwise functionally described herein are antibodies derived from CC-90002 that exhibit 14 amino acid substitutions relative to VH SEQ ID NO:326.

Provided herein is a CD47 antibody wherein the anti-CD47 VL exhibits 1-7 amino acid substitutions relative to SEQ ID NO:325 wherein at least one (1) of said amino acid substitutions is selected from the group consisting of A10S, M11L, K24R, A51E, N52S, L54F, and S56D; and, the anti-CD47 VH exhibits 1-11 amino acid substitutions relative to SEQ ID NO:326 wherein at least one (1) of said amino acid substitutions is selected from the group consisting of T14P, Q43K, A44G, E59Y, D66G, M76T, S84R, S88A, M93V, S102E, and T115L.

Also provided herein is a CD47 antibody described herein wherein the anti-CD47 VL exhibits at least one (1), at least two (2), at least three (3), at least four (4), at least five (5), at least six (6) or at least seven (7) amino acid substitutions relative to SEQ ID NO:325 wherein the amino acid substitution is selected from the group consisting of A10S, M11L, K24R, A51E, N52S, L54F, and S56D.

The invention is directed to an antibody described herein wherein the anti-CD47 VL exhibits at least seven (7) amino acid substitutions relative to SEQ ID NO:325 wherein seven (7) of the amino acid substitutions are A10S, M11L, K24R, A51E, N52S, L54F, and S56D.

The invention is directed to an antibody described herein wherein the anti-CD47 VH exhibits at least one (1), two (2), three (3), four (4), five (5), six (6), seven (7), eight (8), nine (9), ten (10), or eleven (11) amino acid substitution relative to SEQ ID NO:326 wherein the amino acid substitution is selected from the group consisting of T14P, Q43K, A44G, E59Y, D66G, M76T, S84R, S88A, M93V, S102E, and T115L.

The invention is directed to an antibody described herein wherein the anti-CD47 VH exhibits at least eleven (11) amino acid substitutions relative to SEQ ID NO:326 wherein eleven (11) of the amino acid substitutions are T14P, Q43K, A44G, E59Y, D66G, M76T, S84R, S88A, M93V, S102E, and T115L.

Anti-CD47 LC (SEQ ID NO:335) and HC (SEQ ID NO:336) are preferred sources of anti-CD47 elements for construction of bispecific entities described herein, particularly VL (SEQ ID NO:319) and VH (SEQ ID NO:320) which comprise VL CDRs SEQ ID NO:365 (CDRL1), SEQ ID NO:366 (CDRL2), and SEQ ID NO:367 (CDRL3); and, VH CDRs SEQ ID NO:368 (CDRH1), SEQ ID NO:369 (CDRH2), and SEQ ID NO:370 (CDRH3), respectively. Substitutions A10S, M11L, K24R, A51E, N52S, L54F, and S56D are important VL (SEQ ID NO:319) substitutions with regard to CC-90002 to effect low CD47 binding affinity and reduce immunogenicity. T14P, Q43K, A44G, E59Y, D66G, M76T, S84R, S88A, M93V, S102E, and T115L are important VH (SEQ ID NO:320) with regard to CC-90002 to effect low CD47 binding affinity (particularly E59Y and S102E) and reduce immunogenicity. Anti-CD47 IgG1 LC and HC Constant Regions as otherwise described herein, e.g., SEQ ID NO:339 and SEQ ID NO:341, respectively, are in certain embodiments fused to the carboxy termini of VL (SEQ ID NO:319) and VH (SEQ ID NO:320). Anti-CD47 LC (SEQ ID NO:335) is preferred for employment in construction of bispecific entities of the present invention. Anti-CD47 HC (SEQ ID NO:336) is preferred for employment in construction of bispecific entities of the present invention. Substitutions Q124E, L135W, Q160E, and T180E are important SEQ ID NO:335 positions to ensure proper LC/HC pairing formation during production of the IgG1 1+1 heterodimer format. Substitutions Q179K, T371V, T389L, K420L, and T422W are important SEQ ID NO:336 positions to reduce propensity for homodimer formation during production of the IgG1 1+1 heterodimer format.

The invention is further particularly directed to an antibody otherwise described herein wherein the anti-CD47 VL exhibits 1-3 amino acid substitutions relative to SEQ ID NO:325 wherein at least one (1), at least two (2), or at least three (3) amino acid substitution in the anti-CD47 VL (SEQ ID NO: 325) are selected from the group consisting of A10S, M11L, and K24R (e.g., SEQ ID NO:321); and, the anti-CD47 VH exhibits 1-11 amino acid substitutions relative to SEQ ID NO:326 wherein at least one (1), at least two (2), at least three (3), at least four (4), at least five (5), at least six (6), at least seven (7), at least eight (8), at least nine (9), at least ten (10) or at least eleven (11) amino acid substitution in the anti-CD47 VH (SEQ ID NO: 326) are selected from the group consisting of T14P, Q43K, A44G, E59Y, D66G, M76T, S84R, S88A, M93V, S102E, and T115L (e.g., SEQ ID NO:322).

The invention is particularly directed to an antibody otherwise described herein wherein the anti-CD47 VH exhibits 1-11 amino acid substitutions relative to SEQ ID NO:326 wherein at least one (1), at least two (2), at least three (3), at least four (4), at least five (5), at least six (6), at least seven (7), at least eight (8), at least nine (9), at least ten (10) or at least eleven (11) amino acid substitution in the anti-CD47 VH (SEQ ID NO: 326) are selected from the group consisting of T14P, Q43K, A44G, E59Y, D66G, M76T, S84R, S88A, M93V, S102E, and T115L (e.g., SEQ ID NO:322).

Anti-CD47 LC (SEQ ID NO:337) and HC (SEQ ID NO:338) are preferred sources of anti-CD47 elements for construction of bispecific entities described herein, particularly VL (SEQ ID NO:321) and VH (SEQ ID NO:322) which comprise VL CDRs: SEQ ID NO:371, SEQ ID NO:372, and SEQ ID NO:373; and, VH CDRs: SEQ ID NO:374, SEQ ID NO:375, and SEQ ID NO:376, respectively. A10S, M11L, and K24R are important VL (SEQ ID NO:321) positions to effect low CD47 binding affinity and reduce immunogenicity. Substitutions T14P, Q43K, A44G, E59Y, D66G, M76T, S84R, S88A, M93V, S102E, and T115L are important VH (SEQ ID NO:322) positions to effect low CD47 binding affinity (particularly E59Y and S102E) and reduce immunogenicity. Anti-CD47 IgG1 LC and HC Constant Regions as otherwise described herein, e.g., SEQ ID NO:339 and SEQ ID NO:341, respectively, are fused to the carboxy termini of VL (SEQ ID NO:321) and VH (SEQ ID NO:322). Anti-CD47 LC (SEQ ID NO:337) is preferred for employment in construction of bispecific entities of the present invention. Anti-CD47 HC (SEQ ID NO:338) is preferred for employment in construction of bispecific entities of the present invention. Substitutions Q124E, L135W, Q160E, and T180E are important SEQ ID NO:337 positions for reducing the propensity for homodimer formation during production of the IgG1 1+1 heterodimer format. Substitutions Q179K, T371V, T389L, K420L, and T422W are important SEQ ID NO:338 positions for reducing the propensity for homodimer formation during production of the IgG1 1+1 heterodimer format.

The invention is particularly directed to an antibody otherwise described herein wherein the anti-CD47 VL exhibits 1-10 amino acid substitutions relative to SEQ ID NO:325 wherein at least one (1), at least two (2), at least three (3), at least four (4), at least five (5), at least six (6), at least seven (7), at least eight (8), at least nine (9), or at least ten (10) amino acid substitution in the anti-CD47 VL (SEQ ID NO: 325) are selected from the group consisting of A10S, M11L, K24Q, K39D, K42T, K45Q, A51E, N52S, L54F, and S56D (e.g., SEQ ID NO:317); and, the anti-CD47 VH exhibits 1-11 amino acid substitutions relative to SEQ ID NO:326 wherein at least one (1), at least two (2), at least three (3), at least four (4), at least five (5), at least six (6), at least seven (7), at least eight (8), at least nine (9), at least ten (10) or at least eleven (11) amino acid substitution in the anti-CD47 VH (SEQ ID NO: 326) are selected from the group consisting of T14P, A44G, E59Y, D66G, M76T, S84A, R87T, S88A, M93V, S102E, and T115L (e.g., SEQ ID NO:318).

The invention is particularly directed to an antibody otherwise described herein wherein the anti-CD47 VH exhibits 1-11 amino acid substitutions relative to SEQ ID NO:326 wherein at least one (1), at least two (2), at least three (3), at least four (4), at least five (5), at least six (6), at least seven (7), at least eight (8), at least nine (9), at least ten (10) or at least eleven (11) amino acid substitutions in the anti-CD47 VH (SEQ ID NO: 326) are selected from the group consisting of T14P, A44G, E59Y, D66G, M76T, S84A, R87T, S88A, M93V, S102E, and T115L (e.g., SEQ ID NO:318).

Anti-CD47 LC (SEQ ID NO:333) and HC (SEQ ID NO:334) are preferred sources of anti-CD47 elements for construction of bispecific entities described herein, particularly VL (SEQ ID NO:317) and VH (SEQ ID NO:318) which comprise VL CDRs: SEQ ID NO:359, SEQ ID NO:360, and SEQ ID NO:361; and, VH CDRs: SEQ ID NO:362, SEQ ID NO:363, and SEQ ID NO:364, respectively. Substitutions A10S, M11L, K244, K39D, K42T, K45, A51E, N52S, L54F, and S56D are important VL (SEQ ID NO:317) positions to effect low CD47 binding affinity and reduce immunogenicity. Substitutions T14P, A44G, E59Y, D66G, M76T, S84A, R87T, S88A, M93V, S102E, and T115L are important VH (SEQ ID NO:318) positions to effect low CD47 binding affinity (particularly E59Y and S102E) and reduce immunogenicity. Anti-CD47 IgG1 LC and HC Constant Regions as otherwise described herein, e.g., SEQ ID NO:339 and SEQ ID NO:341, respectively, are fused to the carboxy termini of VL (SEQ ID NO:317) and VH (SEQ ID NO:318). Anti-CD47 LC (SEQ ID NO:333) is preferred for employment in construction of bispecific entities of the present invention. Anti-CD47 HC (SEQ ID NO:334) is preferred for employment in construction of bispecific entities of the present invention. Substitutions Q124E, L135W, Q160E, and T180E are important SEQ ID NO:333 positions to reduce propensity for homodimer formation during production of the IgG1 1+1 heterodimer format. Substitutions Q179K, T371V, T389L, K420L, and T422W are important SEQ ID NO:334 positions for reducing the propensity for homodimer formation during production of the IgG1 1+1 heterodimer format.

Example antibodies described and contemplated herein comprise anti-CD20 VL CDRs RASSSVSYIH (SEQ ID NO:353), ATSNLAS (SEQ ID NO:354), and QQWTSNPPT (SEQ ID NO:355); and, VH CDRs SYNMH (SEQ ID NO:356), AIYPGNGDTSYNQKFKG (SEQ ID NO:357), and STYYGGDWYFNV (SEQ ID NO:358). Example bispecific antibodies otherwise described herein comprise anti-CD20 VL (SEQ ID NO: 323) and VH (SEQ ID NO: 324). Example preferred species bispecific antibodies functionally described herein comprise anti-CD20 LC (SEQ ID NO:331) and anti-CD20 HC (SEQ ID NO:332).

161 Examples of Detuned Anti-CD47 VL/VH Fabs Derived from CC-90002

Further provided herein are 161 VL and VH Fabs derived from parental antibody CC-90002. For each of the 161 Fabs, the VL amino acid sequences are provided as odd SEQ ID Nos 1-321; and the VH amino acid sequences are provided as even SEQ ID Nos 2-322. Identified Fabs (VL/VH pairs) identified are each numbered as adjacent SEQ ID NOs, i.e., pairs disclosed herein following the pattern: SEQ ID NO:1/SEQ ID NO:2; SEQ ID NO:3/SEQ ID NO:4, and so forth to SEQ ID NO:321/SEQ ID NO:322:

SEQ ID NO:1/SEQ ID NO:2; SEQ ID NO:3/SEQ ID NO:4; SEQ ID NO:5/SEQ ID NO:6; SEQ ID NO:7/SEQ ID NO:8; SEQ ID NO:9/SEQ ID NO:10; SEQ ID NO:11/SEQ ID NO:12; SEQ ID NO:13/SEQ ID NO:14; SEQ ID NO:15/SEQ ID NO:16; SEQ ID NO:17/SEQ ID NO:18; SEQ ID NO:19/SEQ ID NO:20; SEQ ID NO:21/SEQ ID NO:22; SEQ ID NO:23/SEQ ID NO:24; SEQ ID NO:25/SEQ ID NO:26; SEQ ID NO:27/SEQ ID NO:28; SEQ ID NO:29/SEQ ID NO:30; SEQ ID NO:31/SEQ ID NO:32; SEQ ID NO:33/SEQ ID NO:34; SEQ ID NO:35/SEQ ID NO:36; SEQ ID NO:37/SEQ ID NO:38; SEQ ID NO:39/SEQ ID NO:40; SEQ ID NO:41/SEQ ID NO:42; SEQ ID NO:43/SEQ ID NO:44; SEQ ID NO:45/SEQ ID NO:46; SEQ ID NO:47/SEQ ID NO:48; SEQ ID NO:49/SEQ ID NO:50; SEQ ID NO:51/SEQ ID NO:52; SEQ ID NO:53/SEQ ID NO:54; SEQ ID NO:55/SEQ ID NO:56; SEQ ID NO:57/SEQ ID NO:58; SEQ ID NO:59/SEQ ID NO:60; SEQ ID NO:61/SEQ ID NO:62; SEQ ID NO:63/SEQ ID NO:64; SEQ ID NO:65/SEQ ID NO:66; SEQ ID NO:67/SEQ ID NO:68; SEQ ID NO:69/SEQ ID NO:70; SEQ ID NO:71/SEQ ID NO:72; SEQ ID NO:73/SEQ ID NO:74; SEQ ID NO:75/SEQ ID NO:76; SEQ ID NO:77/SEQ ID NO:78; SEQ ID NO:79/SEQ ID NO:80; SEQ ID NO:81/SEQ ID

NO:82; SEQ ID NO:83/SEQ ID NO:84; SEQ ID NO:85/ SEQ ID NO:86; SEQ ID NO:87/SEQ ID NO:88; SEQ ID NO:89/SEQ ID NO:90; SEQ ID NO:91/SEQ ID NO:92; SEQ ID NO:93/SEQ ID NO:94; SEQ ID NO:95/SEQ ID NO:96; SEQ ID NO:97/SEQ ID NO:98; SEQ ID NO:99/ SEQ ID NO:100; SEQ ID NO:101/SEQ ID NO:102; SEQ ID NO:103/SEQ ID NO:104; SEQ ID NO:105/SEQ ID NO:106; SEQ ID NO:107/SEQ ID NO:108; SEQ ID NO:109/SEQ ID NO:110; SEQ ID NO:111/SEQ ID NO:112; SEQ ID NO:113/SEQ ID NO:114; SEQ ID NO:115/SEQ ID NO:116; SEQ ID NO:117/SEQ ID NO:118; SEQ ID NO:119/SEQ ID NO:120; SEQ ID NO:121/SEQ ID NO:122; SEQ ID NO:123/SEQ ID NO:124; SEQ ID NO:125/SEQ ID NO:126; SEQ ID NO:127/SEQ ID NO:128; SEQ ID NO:129/SEQ ID NO:130; SEQ ID NO:131/SEQ ID NO:132; SEQ ID NO:133/SEQ ID NO:134; SEQ ID NO:135/SEQ ID NO:136; SEQ ID NO:137/SEQ ID NO:138; SEQ ID NO:139/SEQ ID NO:140; SEQ ID NO:141/SEQ ID NO:142; SEQ ID NO:143/SEQ ID NO:144; SEQ ID NO:145/SEQ ID NO:146; SEQ ID NO:147/SEQ ID NO:148; SEQ ID NO:149/SEQ ID NO:150; SEQ ID NO:151/SEQ ID NO:152; SEQ ID NO:153/SEQ ID NO:154; SEQ ID NO:155/SEQ ID NO:156; SEQ ID NO:157/SEQ ID NO:158; SEQ ID NO:159/SEQ ID NO:160; SEQ ID NO:161/SEQ ID NO:162; SEQ ID NO:163/SEQ ID NO:164; SEQ ID NO:165/SEQ ID NO:166; SEQ ID NO:167/SEQ ID NO:168; SEQ ID NO:169/SEQ ID NO:170; SEQ ID NO:171/SEQ ID NO:172; SEQ ID NO:173/SEQ ID NO:174; SEQ ID NO:175/SEQ ID NO:176; SEQ ID NO:177/SEQ ID NO:178; SEQ ID NO:179/SEQ ID NO:180; SEQ ID NO:181/SEQ ID NO:182; SEQ ID NO:183/SEQ ID NO:184; SEQ ID NO:185/SEQ ID NO:186; SEQ ID NO:187/SEQ ID NO:188; SEQ ID NO:189/SEQ ID NO:190; SEQ ID NO:191/SEQ ID NO:192; SEQ ID NO:193/SEQ ID NO:194; SEQ ID NO:195/SEQ ID NO:196; SEQ ID NO:197/SEQ ID NO:198; SEQ ID NO:199/SEQ ID NO:200; SEQ ID NO:201/SEQ ID NO:202; SEQ ID NO:203/SEQ ID NO:204; SEQ ID NO:205/SEQ ID NO:206; SEQ ID NO:207/SEQ ID NO:208; SEQ ID NO:209/SEQ ID NO:210; SEQ ID NO:211/SEQ ID NO:212; SEQ ID NO:213/SEQ ID NO:214; SEQ ID NO:215/SEQ ID NO:216; SEQ ID NO:217/SEQ ID NO:218; SEQ ID NO:219/SEQ ID NO:220; SEQ ID NO:221/SEQ ID NO:222; SEQ ID NO:223/SEQ ID NO:224; SEQ ID NO:225/SEQ ID NO:226; SEQ ID NO:227/SEQ ID NO:228; SEQ ID NO:229/SEQ ID NO:230; SEQ ID NO:231/SEQ ID NO:232; SEQ ID NO:233/SEQ ID NO:234; SEQ ID NO:235/SEQ ID NO:236; SEQ ID NO:237/SEQ ID NO:238; SEQ ID NO:239/SEQ ID NO:240; SEQ ID NO:241/SEQ ID NO:242; SEQ ID NO:243/SEQ ID NO:244; SEQ ID NO:245/SEQ ID NO:246; SEQ ID NO:247/SEQ ID NO:248; SEQ ID NO:249/SEQ ID NO:250; SEQ ID NO:251/SEQ ID NO:252; SEQ ID NO:253/SEQ ID NO:254; SEQ ID NO:255/SEQ ID NO:256; SEQ ID NO:257/SEQ ID NO:258; SEQ ID NO:259/SEQ ID NO:260; SEQ ID NO:261/SEQ ID NO:262; SEQ ID NO:263/SEQ ID NO:264; SEQ ID NO:265/SEQ ID NO:266; SEQ ID NO:267/SEQ ID NO:268; SEQ ID NO:269/SEQ ID NO:270; SEQ ID NO:271/SEQ ID NO:272; SEQ ID NO:273/SEQ ID NO:274; SEQ ID NO:275/SEQ ID NO:276; SEQ ID NO:277/SEQ ID NO:278; SEQ ID NO:279/SEQ ID NO:280; SEQ ID NO:281/SEQ ID NO:282; SEQ ID NO:283/SEQ ID NO:284; SEQ ID NO:285/SEQ ID NO:286; SEQ ID NO:287/SEQ ID NO:288; SEQ ID NO:289/SEQ ID NO:290; SEQ ID NO:291/SEQ ID NO:292; SEQ ID NO:293/SEQ ID NO:294; SEQ ID NO:295/SEQ ID NO:296; SEQ ID NO:297/SEQ ID NO:298; SEQ ID NO:299/SEQ ID NO:300; SEQ ID NO:301/SEQ ID NO:302; SEQ ID NO:303/SEQ ID NO:304; SEQ ID NO:305/SEQ ID NO:306; SEQ ID NO:307/SEQ ID NO:308; SEQ ID NO:309/SEQ ID NO:310; SEQ ID NO:311/SEQ ID NO:312; SEQ ID NO:315/SEQ ID NO:316; SEQ ID NO:317/SEQ ID NO:318; SEQ ID NO:319/SEQ ID NO:320; and, SEQ ID NO:321/SEQ ID NO:322.

Although preferred, this disclosure is not limited to each pair as indicated, per se. The population of VL and VH region species disclosed herein can be employed to form distinct pairs i.e., diverse Fabs selected from the population of VL and VH species regions provided.

Example antibodies otherwise functionally described herein are provided wherein the anti-CD47 VL is selected from the group consisting of SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO:113, SEQ ID NO:115, SEQ ID NO:117, SEQ ID NO:119, SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO:153, SEQ ID NO:155, SEQ ID NO:157, SEQ ID NO:159, SEQ ID NO:161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287, SEQ ID NO:289, SEQ ID NO:291, SEQ ID NO:293, SEQ ID NO:295, SEQ ID NO:297, SEQ ID NO:299, SEQ ID NO:301, SEQ ID NO:303, SEQ ID NO:305, SEQ ID NO:307, SEQ ID NO:309, SEQ ID NO:311, SEQ ID NO:313, SEQ ID NO:315, SEQ ID NO:317, SEQ ID NO:319, and SEQ ID NO:321; and, the anti-CD47 VH is selected from the group consisting of SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, SEQ ID NO:146, SEQ ID NO:148, SEQ ID NO:150, SEQ ID NO:152, SEQ ID NO:154, SEQ ID NO:156, SEQ ID NO:158, SEQ ID NO:160, SEQ ID NO:162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO:184, SEQ ID NO:186, SEQ ID NO:188, SEQ ID NO:190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:208, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:255, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288, SEQ ID NO:290, SEQ ID NO:292, SEQ ID NO:294, SEQ ID NO:296, SEQ ID NO:298, SEQ ID NO:300, SEQ ID NO:302, SEQ ID NO:304, SEQ ID NO:306, SEQ ID NO:308, SEQ ID NO:310, SEQ ID NO:312, SEQ ID NO:314, SEQ ID NO:316, SEQ ID NO:318, SEQ ID NO:320, and SEQ ID NO:322.

II. Bispecific Antibodies Comprising Anti-CD47 Derived from CL-4033

OMT Derived Detuning and CL-4033

OmniRat animals were immunized with the extra-cellular domain (ECD) of human CD47. OmniRat animals are transgenic animals that express human light and heavy chain repertoires, such that the antibodies produced in response to immunization contain fully human sequences. From this immunization campaign, 37 variants were made of a selected antibody in the light chain CDRL2 in an attempt to reduce its potential immunogenicity. From these 37 variants, 11 were selected for further development based upon preservation of function, expressability, and predicted low immunogenicity. From this list, CL-4033 was selected for detuning.

A homology model of CL-4033 was constructed and a library of variants that would be predicted to have a range of lower affinities to CD47, with good stability, and low immunogenicity were designed. 64 of the detuned CL-4033 variants were then paired with the anti-CD20 rituximab arm using mutations.

CD47×CD20 bispecific entities described herein are designed to promote CD20-restricted blockade of the CD47-SIRPα "don't eat me" signal on cancer cells that express both CD20 and CD47, while sparing CD47$^+$/CD20− normal cells. Multiple steps of protein engineering led to the anti-CD47 Fabs of the bispecific entities described herein. (1) Protein engineering was employed on both VH and VL chains of CL-4033 to reduce immunogenicity, while retaining functionality; and, (2) Protein engineering was employed to tune down CD47 binding affinity of CL-4033. IgG1 bispecific antibodies targeting CD47 and CD20 with reduced affinity to CD47, described and exemplified herein, 1) retain efficacy in mediating anti-tumor function by targeting the CD47-SIRPα interaction and engaging activating receptors FcγRs; 2) minimize target-mediated sink effects and toxicity observed with anti-CD47 therapeutics; 3) incorporate CD47 and CD20 engagement in a single molecule avoiding the need for combination therapy with 2 monoclonal antibodies.

64 Examples of Detuned Anti-CD47 VL/VH Fabs Derived from CL-4033

Further provided herein are 64 VL and VH Fab regions derived from parental antibody CL-4033. Each of the 64 Fab VL regions are provided as odd SEQ ID NOs 383 and 387-511; the VH regions are provided as even SEQ ID NOs 384 and 388-512. A first example Fab (VL/VH pair) is identified as SEQ ID NO:383/384. Further identified Fab (VL/VH pairs) are each numbered as adjacent SEQ ID Nos, i.e., pairs disclosed herein following the pattern: SEQ ID NO:387/SEQ ID NO:388; SEQ ID NO:389/SEQ ID NO:390, and so forth to SEQ ID NO:503/SEQ ID NO:504; SEQ ID NO:505/SEQ ID NO:506; SEQ ID NO:507/SEQ ID NO:508; SEQ ID NO:509/SEQ ID NO:510; SEQ ID NO:511/SEQ ID NO:512:

SEQ ID NO:387/SEQ ID NO:388; SEQ ID NO:389/SEQ ID NO:390; SEQ ID NO:391/SEQ ID NO:392; SEQ ID NO:393/SEQ ID NO:394; SEQ ID NO:395/SEQ ID NO:396; SEQ ID NO:397/SEQ ID NO:398; SEQ ID NO:399/SEQ ID NO:400; SEQ ID NO:401/SEQ ID NO:402; SEQ ID NO:403/SEQ ID NO:404; SEQ ID NO:405/SEQ ID NO:406; SEQ ID NO:407/SEQ ID NO:408; SEQ ID NO:409/SEQ ID NO:410; SEQ ID NO:411/SEQ ID NO:412; SEQ ID NO:413/SEQ ID NO:414; SEQ ID NO:415/SEQ ID NO:416; SEQ ID NO:417/SEQ ID NO:418; SEQ ID NO:419/SEQ ID NO:420; SEQ ID NO:421/SEQ ID NO:422; SEQ ID NO:423/SEQ ID NO:424; SEQ ID NO:425/SEQ ID NO:426; SEQ ID NO:427/SEQ ID NO:428; SEQ ID NO:429/SEQ ID NO:430; SEQ ID NO:431/SEQ ID NO:432; SEQ ID NO:433/SEQ ID NO:434; SEQ ID NO:435/SEQ ID NO:436; SEQ ID NO:437/SEQ ID NO:438; SEQ ID NO:439/SEQ ID NO:440; SEQ ID NO:441/SEQ ID NO:442; SEQ ID NO:443/SEQ ID NO:444; SEQ ID NO:445/SEQ ID NO:446; SEQ ID NO:447/SEQ ID NO:448; SEQ ID NO:449/SEQ ID NO:450; SEQ ID NO:451/SEQ ID NO:452; SEQ ID NO:453/SEQ ID NO:454; SEQ ID NO:455/SEQ

NO:456; SEQ ID NO:457/SEQ ID NO:458; SEQ ID NO:459/SEQ ID NO:460; SEQ ID NO:461/SEQ ID NO:462; SEQ ID NO:463/SEQ ID NO:464; SEQ ID NO:465/SEQ ID NO:466; SEQ ID NO:467/SEQ ID NO:468; SEQ ID NO:469/SEQ ID NO:470; SEQ ID NO:471/SEQ ID NO:472; SEQ ID NO:473/SEQ ID NO:474/SEQ ID NO:475/SEQ ID NO:476; SEQ ID NO:477/SEQ ID NO:478; SEQ ID NO:479/SEQ ID NO:480; SEQ ID NO:481/SEQ ID NO:482; SEQ ID NO:483/SEQ ID NO:484; SEQ ID NO:485/SEQ ID NO:486; SEQ ID NO:487/SEQ ID NO:488; SEQ ID NO:489/SEQ ID NO:490; SEQ ID NO:491/SEQ ID NO:492; SEQ ID NO:493/SEQ ID NO:494; SEQ ID NO:495/SEQ ID NO:496; SEQ ID NO:497/SEQ ID NO:498; SEQ ID NO:499/SEQ ID NO:500; SEQ ID NO:501/SEQ ID NO:502; SEQ ID NO:503/SEQ ID NO:504; SEQ ID NO:505/SEQ ID NO:506; SEQ ID NO:507/SEQ ID NO:508; SEQ ID NO:509/SEQ ID NO:510; and, SEQ ID NO:511/SEQ ID NO:512.

Although preferred, this disclosure is not limited to each pair as indicated, per se. The population of VL and VH region species disclosed herein can be employed to form distinct pairs i.e., diverse Fabs selected from the population of VL and VH species regions provided.

Example antibodies otherwise functionally described herein are provided wherein the anti-CD47 VL is selected from the group consisting of SEQ ID NO:383, SEQ ID NO:387, SEQ ID NO:389, SEQ ID NO:391, SEQ ID NO:393, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, SEQ ID NO:437, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, SEQ ID NO:481, SEQ ID NO:483, SEQ ID NO:485, SEQ ID NO:487, SEQ ID NO:489, SEQ ID NO:491, SEQ ID NO:493, SEQ ID NO:495, SEQ ID NO:497, SEQ ID NO:499, SEQ ID NO:501, SEQ ID NO:503, SEQ ID NO:505, SEQ ID NO:507, SEQ ID NO:509, and SEQ ID NO:511; and, the anti-CD47 VH is selected from the group consisting of SEQ ID NO:384, SEQ ID NO:388, SEQ ID NO:390, SEQ ID NO:392, SEQ ID NO:394, SEQ ID NO:396, SEQ ID NO:398, SEQ ID NO:400, SEQ ID NO:402, SEQ ID NO:404, SEQ ID NO:406, SEQ ID NO:408, SEQ ID NO:410, SEQ ID NO:412, SEQ ID NO:414, SEQ ID NO:416, SEQ ID NO:418, SEQ ID NO:420, SEQ ID NO:422, SEQ ID NO:424, SEQ ID NO:426, SEQ ID NO:428, SEQ ID NO:430, SEQ ID NO:432, SEQ ID NO:434, SEQ ID NO:436, SEQ ID NO:438, SEQ ID NO:440, SEQ ID NO:442, SEQ ID NO:444, SEQ ID NO:446, SEQ ID NO:448, SEQ ID NO:450, SEQ ID NO:452, SEQ ID NO:454, SEQ ID NO:456, SEQ ID NO:458, SEQ ID NO:460, SEQ ID NO:462, SEQ ID NO:464, SEQ ID NO:466, SEQ ID NO:468, SEQ ID NO:470, SEQ ID NO:472, SEQ ID NO:474, SEQ ID NO:476, SEQ ID NO:478, SEQ ID NO:480, SEQ ID NO:482, SEQ ID NO:484, SEQ ID NO:486, SEQ ID NO:488, SEQ ID NO:490, SEQ ID NO:492, SEQ ID NO:494, SEQ ID NO:496, SEQ ID NO:498, SEQ ID NO:500, SEQ ID NO:502, SEQ ID NO:504, SEQ ID NO:506, SEQ ID NO:508, SEQ ID NO:510, and SEQ ID NO:512.

Also provided are example antibodies wherein the Fab portion that binds CD47 comprises (i) a light chain variable region (VL) region comprising VL CDRs selected from VL (CDR1, CDR2, and CDR3) sets consisting of (SEQ ID NO:377, SEQ ID NO:378, SEQ ID NO:379), (SEQ ID NO:513, SEQ ID NO:514, SEQ ID NO:515), (SEQ ID NO:519, SEQ ID NO:520, SEQ ID NO:521), (SEQ ID NO:525, SEQ ID NO:526, SEQ ID NO:527), (SEQ ID NO:531, SEQ ID NO:532, SEQ ID NO:533), (SEQ ID NO:537, SEQ ID NO:538, SEQ ID NO:539), (SEQ ID NO:543, SEQ ID NO:544, SEQ ID NO:545), (SEQ ID NO:549, SEQ ID NO:550, SEQ ID NO:551), (SEQ ID NO:555, SEQ ID NO:556, SEQ ID NO:557), (SEQ ID NO:561, SEQ ID NO:562, SEQ ID NO:563), (SEQ ID NO:567, SEQ ID NO:568, SEQ ID NO:569), (SEQ ID NO:573, SEQ ID NO:574, SEQ ID NO:575), (SEQ ID NO:579, SEQ ID NO:580, SEQ ID NO:581), (SEQ ID NO:585, SEQ ID NO:586, SEQ ID NO:587), (SEQ ID NO:591, SEQ ID NO:592, SEQ ID NO:593), (SEQ ID NO:597, SEQ ID NO:598, SEQ ID NO:599), (SEQ ID NO:603, SEQ ID NO:604, SEQ ID NO:605), (SEQ ID NO:609, SEQ ID NO:610, SEQ ID NO:611), (SEQ ID NO:615, SEQ ID NO:616, SEQ ID NO:617), (SEQ ID NO:621, SEQ ID NO:622, SEQ ID NO:623), (SEQ ID NO:627, SEQ ID NO:628, SEQ ID NO:629), (SEQ ID NO:633, SEQ ID NO:634, SEQ ID NO:635), (SEQ ID NO:639, SEQ ID NO:640, SEQ ID NO:641), (SEQ ID NO:645, SEQ ID NO:646, SEQ ID NO:647), (SEQ ID NO:651, SEQ ID NO:652, SEQ ID NO:653), (SEQ ID NO:657, SEQ ID NO:658, SEQ ID NO:659), (SEQ ID NO:663, SEQ ID NO:664, SEQ ID NO:665), (SEQ ID NO:669, SEQ ID NO:670, SEQ ID NO:671), (SEQ ID NO:675, SEQ ID NO:676, SEQ ID NO:677), (SEQ ID NO:681, SEQ ID NO:682, SEQ ID NO:683), (SEQ ID NO:687, SEQ ID NO:688, SEQ ID NO:689), (SEQ ID NO:693, SEQ ID NO:694, SEQ ID NO:695), (SEQ ID NO:699, SEQ ID NO:700, SEQ ID NO:701), (SEQ ID NO:705, SEQ ID NO:706, SEQ ID NO:707), (SEQ ID NO:711, SEQ ID NO:712, SEQ ID NO:713), (SEQ ID NO:717, SEQ ID NO:718, SEQ ID NO:719), (SEQ ID NO:723, SEQ ID NO:724, SEQ ID NO:725), (SEQ ID NO:729, SEQ ID NO:730, SEQ ID NO:731), (SEQ ID NO:735, SEQ ID NO:736, SEQ ID NO:737), (SEQ ID NO:741, SEQ ID NO:742, SEQ ID NO:743), (SEQ ID NO:747, SEQ ID NO:748, SEQ ID NO:749), (SEQ ID NO:753, SEQ ID NO:754, SEQ ID NO:755), (SEQ ID NO:759, SEQ ID NO:760, SEQ ID NO:761), (SEQ ID NO:765, SEQ ID NO:766, SEQ ID NO:767), (SEQ ID NO:771, SEQ ID NO:772, SEQ ID NO:773), (SEQ ID NO:777, SEQ ID NO:778, SEQ ID NO:779), (SEQ ID NO:783, SEQ ID NO:784, SEQ ID NO:785), (SEQ ID NO:789, SEQ ID NO:790, SEQ ID NO:791), (SEQ ID NO:795, SEQ ID NO:796, SEQ ID NO:797), (SEQ ID NO:801, SEQ ID NO:802, SEQ ID NO:803), (SEQ ID NO:807, SEQ ID NO:808, SEQ ID NO:809), (SEQ ID NO:813, SEQ ID NO:814, SEQ ID NO:815), (SEQ ID NO:819, SEQ ID NO:820, SEQ ID NO:821), (SEQ ID NO:825, SEQ ID NO:826, SEQ ID NO:827), (SEQ ID NO:831, SEQ ID NO:832, SEQ ID NO:833), (SEQ ID NO:837, SEQ ID NO:838, SEQ ID NO:839), (SEQ ID NO:843, SEQ ID NO:844, SEQ ID NO:845), (SEQ ID NO:849, SEQ ID NO:850, SEQ ID NO:851), (SEQ ID NO:855, SEQ ID NO:856, SEQ ID NO:857), (SEQ ID NO:861, SEQ ID NO:862, SEQ ID NO:863), (SEQ ID NO:867, SEQ ID NO:868, SEQ ID NO:869), (SEQ ID NO:873, SEQ ID NO:874, SEQ ID NO:875), (SEQ ID NO:879, SEQ ID NO:880, SEQ ID NO:881), and, (SEQ ID NO:885, SEQ ID NO:886, SEQ ID NO:887); and, (ii) a heavy chain variable region (VH) region comprising VH CDRs selected from VH (CDR1, CDR2, and CDR3) sets consisting of (SEQ ID NO:380, SEQ ID NO:381, SEQ ID NO:382), (SEQ ID NO:516, SEQ ID NO:517, SEQ ID NO:518), (SEQ ID NO:522, SEQ ID NO:523, SEQ ID NO:524), (SEQ ID NO:528, SEQ ID NO:529, SEQ ID NO:530), (SEQ ID NO:534, SEQ ID NO:535, SEQ ID NO:536), (SEQ ID NO:540, SEQ ID NO:541, SEQ ID NO:542), (SEQ ID NO:546, SEQ ID NO:547, SEQ ID NO:548), (SEQ ID NO:552, SEQ ID NO:553, SEQ ID NO:554), (SEQ ID NO:558, SEQ ID NO:559, SEQ ID NO:560), (SEQ ID NO:564, SEQ ID NO:565, SEQ ID NO:566), (SEQ ID NO:570, SEQ ID NO:571, SEQ ID NO:572), (SEQ ID NO:576, SEQ ID NO:577, SEQ ID NO:578), (SEQ ID NO:582, SEQ ID NO:583, SEQ ID NO:584), (SEQ ID NO:588, SEQ ID NO:589, SEQ ID NO:590), (SEQ ID NO:594, SEQ ID NO:595, SEQ ID NO:596), (SEQ ID NO:600, SEQ ID NO:601, SEQ ID NO:602), (SEQ ID NO:606, SEQ ID NO:607, SEQ ID NO:608), (SEQ ID NO:612, SEQ ID NO:613, SEQ ID NO:614), (SEQ ID NO:618, SEQ ID NO:619, SEQ ID NO:620), (SEQ ID NO:624, SEQ ID NO:625, SEQ ID NO:626), (SEQ ID NO:630, SEQ ID NO:631, SEQ ID NO:632), (SEQ ID NO:636, SEQ ID NO:637, SEQ ID NO:638), (SEQ ID NO:642, SEQ ID NO:643, SEQ ID NO:644), (SEQ ID NO:648, SEQ ID NO:649, SEQ ID NO:650), (SEQ ID NO:654, SEQ ID NO:655, SEQ ID NO:656), (SEQ ID NO:660, SEQ ID NO:661, SEQ ID NO:662), (SEQ ID NO:666, SEQ ID NO:667, SEQ ID NO:668), (SEQ ID NO:672, SEQ ID NO:673, SEQ ID NO:674), (SEQ ID NO:678, SEQ ID NO:679, SEQ ID NO:680), (SEQ ID NO:684, SEQ ID NO:685, SEQ ID NO:686), (SEQ ID NO:690, SEQ ID NO:691, SEQ ID NO:692), (SEQ ID NO:696, SEQ ID NO:697, SEQ ID NO:698), (SEQ ID NO:702, SEQ ID NO:703, SEQ ID NO:704), (SEQ ID NO:708, SEQ ID NO:709, SEQ ID NO:710), (SEQ ID NO:714, SEQ ID NO:715, SEQ ID NO:716), (SEQ ID NO:720, SEQ ID NO:721, SEQ ID NO:722), (SEQ ID NO:726, SEQ ID NO:727, SEQ ID NO:728), (SEQ ID NO:732, SEQ ID NO:733, SEQ ID NO:734), (SEQ ID NO:738, SEQ ID NO:739, SEQ ID NO:740), (SEQ ID NO:744, SEQ ID NO:745, SEQ ID NO:746), (SEQ ID NO:750, SEQ ID NO:751, SEQ ID NO:752), (SEQ ID NO:756, SEQ ID NO:757, SEQ ID NO:758), (SEQ ID NO:762, SEQ ID NO:763, SEQ ID NO:764), (SEQ ID NO:768, SEQ ID NO:769, SEQ ID NO:770), (SEQ ID NO:774, SEQ ID NO:775, SEQ ID NO:776), (SEQ ID NO:780, SEQ ID NO:781, SEQ ID NO:782), (SEQ ID NO:786, SEQ ID NO:787, SEQ ID NO:788), (SEQ ID NO:792, SEQ ID NO:793, SEQ ID NO:794), (SEQ ID NO:798, SEQ ID NO:799, SEQ ID NO:800), (SEQ ID NO:804, SEQ ID NO:805, SEQ ID NO:806), (SEQ ID NO:810, SEQ ID NO:811, SEQ ID NO:812), (SEQ ID NO:816, SEQ ID NO:817, SEQ ID NO:818), (SEQ ID NO:822, SEQ ID NO:823, SEQ ID NO:824), (SEQ ID NO:828, SEQ ID NO:829, SEQ ID NO:830), (SEQ ID NO:834, SEQ ID NO:835, SEQ ID NO:836), (SEQ ID NO:840, SEQ ID NO:841, SEQ ID NO:842), (SEQ ID NO:846, SEQ ID NO:847, SEQ ID NO:848), (SEQ ID NO:852, SEQ ID NO:853, SEQ ID NO:854), (SEQ ID NO:858, SEQ ID NO:859, SEQ ID NO:860), (SEQ ID NO:864, SEQ ID NO:865, SEQ ID NO:866), (SEQ ID NO:870, SEQ ID NO:871, SEQ ID NO:872), (SEQ ID NO:876, SEQ ID NO:877, SEQ ID NO:878), (SEQ ID NO:882, SEQ ID NO:883, SEQ ID NO:884), and, (SEQ ID NO:888, SEQ ID NO:889, SEQ ID NO:890).

Properties of CD47×CD20 Bispecific Entities of the Present Invention

In vitro affinity measurements with the extracellular domain of the effector antigen, CD47, initially revealed a 100-200-fold decrease in affinity for these variants. In vitro affinity measurements with the extra-cellular domain of CD47 revealed that the variants had a 100-500-fold decrease in affinity. In vivo and in vitro cell based studies with these detuned IgG1 1+1 heterodimer format bispecifics confirmed effector-based cell killing and decreased binding to non-target cell types relative to a monospecific antibody. Anti-CD20 VL: SEQ ID NO:323; anti-CD20 VH: SEQ ID NO:324. Anti-CD20 LC constant region is SEQ ID NO:343. Anti-CD20 HC constant region is SEQ ID NO:345.

Bispecific entities described, exemplified, and claimed herein demonstrate selective binding to CD20-expressing cells, for example, wherein the interaction of CD47 with the macrophage checkpoint inhibitor, signal-regulatory protein alpha (SIRPα), is blocked. This increased selectivity over monospecific anti-CD47 approaches allows for the use of an IgG1 Fc, which engages activating fragment crystallizable gamma receptors (FcγRs) to fully potentiate macrophages to engulf and destroy CD20 positive cells. In comparison to the anti-CD20 antibody rituximab, for example, anti-CD47/anti-CD20 bispecific antibodies described and exemplified herein are more potent in inducing phagocytosis and ADCC in vitro.

In vitro cell-based studies demonstrate that detuned CD47 bispecific entities described herein activate antibody-dependent cellular phagocytosis, complement-dependent cytotoxicity (CDC), and antibody-dependent cellular cytotoxicity (ADCC). See FIGS. 4A-4C and 5A-5C. Further, cynomolgus (cyno) monkey pharmacokinetic (PK) and exploratory toxicity (E-tox) studies experiments demonstrate the detuned CD47 bispecifics effectively deplete B-cells and have reduced binding to cynomolgus red blood cells (RBCs) relative to the parental monospecific anti-CD47 antibody, thereby substantially confirming the success and medical value of the target-cell selective strategy described and claimed herein. Species exemplified herein demonstrate favorable pharmacokinetics and depletion of CD20$^+$ B cells with minimum deleterious effects seen on hematologic parameters following multiple administrations to nonhuman primates.

In specific embodiments, CD47×CD20 bispecifics provided herein, designated TPP-1360, TPP-1361, TPP-1367, and TPP-1362, comprise heavy and light chain sequences as follows: TPP-1360 comprises (CD47 LC SEQ ID NO:335; HC SEQ ID NO:336)×(CD20 LC SEQ ID NO:331; HC SEQ ID NO:332). TPP-1361 comprises (CD47 LC SEQ ID NO:333; HC SEQ ID NO:334)×(CD20 LC SEQ ID NO:331; HC SEQ ID NO:332). TPP-1367 comprises (CD47 LC SEQ ID NO:337; HC SEQ ID NO:338)×(CD20 LC SEQ ID NO:331; HC SEQ ID NO:332). TPP-1362 comprises (CD47 LC SEQ ID NO:385; HC SEQ ID NO:386)×(CD20 LC SEQ ID NO:331; HC SEQ ID NO:332).

With regard to TPP-1362, the CD47 VL comprises SEQ ID NO:383. TPP-1362 CD47 VH comprises SEQ ID NO:384. TPP-1362 CD47 VL CDRs comprise SEQ ID NO:377 (CDRL1); SEQ ID NO:378 (CDRL2); and, SEQ ID NO:379 (CDRL3). TPP-1362 CD47 VH CDRs comprise SEQ ID NO:380 (CDRH1); SEQ ID NO:381 (CDRH2); and, SEQ ID NO:382 (CDRH3).

An Example Series of Bispecific Entities within the Genera Otherwise Described Herein are Demonstrated to Exhibit Pharmacology Characteristics Generally Indicative of the Therapeutic Value of the Genera.

These highly evaluated species, for example, exhibit high affinity to CD20 and detuned affinity to CD47, showing effective CD47 blocking, cyno-cross reactivity, good physicochemical properties (solubility, stability, expression), and low immunogenicity prediction (Epivax). See Example 15, FIG. 18. The IgG1 heterodimer format and Fc confer reliable production in sufficient amounts and purity using standard CHO processes, with phase appropriate titer, yield, product quality and liquid formulation. These example highly evaluated species exhibit in vitro phagocytosis capacity of CD20 tumor cells superior to CC-90002 and more potent ADCC than rituximab. These example highly evaluated species also exhibit marked reduction in cyno B cells in peripheral blood and lymphoid tissues. These example highly evaluated species also exhibit minimal sink effects with no binding to CD20-CD47$^+$ healthy cells (RBC and platelets). These example highly evaluated species also exhibit acceptable PK parameters to support weekly, for example, dosing.

RBC binding capacity of TPP-1360, for example, was extensively evaluated in purified human RBCs and in co-culture of human RBCs with tumor cells. As illustrated in FIG. 8, TPP-1360 is demonstrated to selectively bind CD47$^+$/CD20+Raji Cells but Not CD47$^+$/CD20$^-$ human RBCs. Moreover, in a co-culture of Raji cells and human RBCs, TPP-1360 displayed dose-dependent binding to CD47$^+$/CD20$^+$ Raji cells but no binding to human RBCs, even at concentration as high as 1 mg/mL. See, FIG. 9. To the contrary, the CD47 wild type/CD20 bispecific, TPP-2, significantly bound to both Raji cells and human RBCs. In addition, TPP-1360 does not show binding to purified cyno RBC from multiple donors.

TPP-1360, an example species bispecific entity of the present disclosure, is a first-in-class antibody, co-targeting CD47 and CD20, designed to bind CD20 with high affinity and CD47 with optimally detuned affinity. When bound to CD20 expressing cells, TPP-1360, for example, not only blocks macrophage checkpoint inhibitor SIRPα interaction with CD47 but also engages activating FcγRs to fully potentiate macrophages to engulf and destroy CD20 positive cells. Potent in vitro activity is induced by TPP-1360, for example, to eliminate cancer cells via multiple modes of action, including phagocytosis, ADCC and CDC. TPP-1360, exemplary of the bispecific entities described herein, provides enhanced pharmacological activities over rituximab and CC-90002.

CD47×CD20 bispecific entities described and claimed herein demonstrate enhanced phagocytosis compared to rituximab or CC-90002 as a single agent. Phagocytosis activity of CD47×CD20 bispecific entities described herein generally correlate with their CD47 binding affinity. CD47× CD20 bispecific entities described herein single agent activity is equivalent to the combination of CC-90002 and rituximab in inducing phagocytosis.

CD47×CD20 bispecific entities described herein demonstrate improved ADCC in rituximab sensitive and resistant tumor cells as compared to single agent anti-CD47 activity.

CD47×CD20 bispecific entities described herein demonstrate better efficacy than rituximab in vivo in Raji NOD-SCID model. See Example 16.

TPP-1360 enhances both phagocytosis and ADCC activity over rituximab. In addition, TPP-1360 and related bispecific entities described, exemplified, and claimed herein, differentiate from CD20×CD3 bispecific T-cell engagers such as REGN1979 from Regeneron, or mosunetuzumab from Roche, now in the clinic as it has different modes of action, including phagocytosis, ADCC and CDC, compared to T cell activation. Furthermore, the toxicity profile is different from CD20×CD3 (potential hematologic toxicity vs cytokine release syndrome). Particularly, T-cell engagers are potent immune engagers that have the potential to trigger apoptosis of non-target cells which express very low levels of the target antigen, therefore either the target antigen needs to be extremely specific or the anti-targeting arm of the bispecific needs to employ either a masking technology or be tuned to differentiate between the levels of expression of the target antigen on normal and disease tissue. Additionally, the anti-CD3 portion of the bispecific needs to be precisely tuned to prevent cytokine release due to systemic activation of T-cells. Importantly, TPP-1360, as a representative example herein, demonstrates favorable elimination kinetics with minimum deleterious effects seen on hematologic parameters following multiple administrations to nonhuman primates. CD47×CD20 bispecific antibodies of the present invention are developed inter alia as intravenous (IV) injectable treatment for B-lymphoma patients, for example, refractory and/or resistant to current therapies.

Bispecific entities described herein are provided for methods of treatment and/or control of tumors, tumor cells, cancer, including but not limited to cells undergoing aberrant proliferation, hematological oncology conditions, hematological malignancies, lymphoproliferative disorders, B-cell disorders, B-cell malignancies, and/or B-cell lymphoma. Bispecific entities of the present invention are formulated and administered according to and consistent with the current state of the art of antibodies as therapeutic entities. Standards of formulation and administration of IgG1 antibodies, for example, are well-known in the art. Antibodies described herein are administered, for example, as an intravenous (IV) injectable treatment for CD20 positive B cell lymphoma patients. The invention is directed to a method of controlling tumor cells comprising administering an effective amount of a bispecifc entity described herein to a patient in need thereof. Tumor cells refer to cancer cells including but not limited to cells undergoing aberrant proliferation, hematological oncology conditions, hematological malignancies, lymphoproliferative disorders, B-cell disorders, B-cell malignancies, and B-cell lymphoma.

CD47×CD20 bispecific entities described herein are particularly provided to be employed in a method treatment of a B-cell disorder or a B-cell malignancy comprising administering an effective amount of a bispecifc entity described herein to a patient in need thereof.

Allometry and Human Pharmacokinetics are evaluated for bispecific entities described herein. The entities of the present invention comprise a detuned CD47 binding arm and a regular CD20 (rituximab) binding arm. Given the detuned binding affinity of the CD47 arm, the target-mediated drug disposition (TMDD) for the bispecific entities is potentially primarily driven by the CD20 binding. Accordingly, in certain embodiments, the clinical doses will be in the ranges of what is currently used for rituximab. Based on the 10, 20 and 100 mg/kg doses in cynomolgus monkeys, the terminal half-life is approximately 7 days. CD20 mediated TMDD is based on additional preclinical and clinical data for rituximab. The first-in-human clinical study is an open-label, multicenter, Phase 1/1b study to evaluate the safety and tolerability in subjects with relapsed or refractory CD20+ NHL who have progressed on rituximab and/or other CD20- targeted therapies. Dose escalation begins at less than 1 mg/kg and then escalates to 10 mg/kg, which is the current clinical dose for rituximab. Cynomolgus monkeys were dosed twice at 20 mg/kg, on day 1 and day 15. Bispecific entities described herein are found to be well tolerated as single agent in NHP eTOX study with dose-proportional exposure. Mammalian or human dosage of bispecific entities described herein is within the range of about 3 mg/kg to about 20 mg/kg. Further mammalian or human dosage of bispecific entities described herein is particularly within the range of about 5 mg/kg to about 15 mg/kg. Mammalian or human dosage of bispecific entities described herein is also between about 7 mg/kg and about 13 mg/kg. Dosage regimen of bispecific entities described herein is about once every five (5) days, or about once a week (seven (7) days), or about once every ten (10) days, or about once every two (2) weeks.

A manufacturing process for bispecific antibodies described herein may follow a typical Chinese Hamster Ovary (CHO) manufacturing platform. A common contaminant observed in the purification of bispecific antibodies is the half-antibody, which requires specific purification protocols to remove. After expression of the 4 chain bispecific in Chinese Hamster Ovary cell, protein A is used as the first step to purify an IgG based bispecific. Following this first step there are generally two species present, the desired 4 chain bispecific and a half-antibody. In most cases ion exchange chromatography is sufficient to separate these two species, but in others hydrophobic interaction chromatography may be required. Correct pairing of the LCs should be assessed by mass spectrometry and mis-assembled impurities should be removed by additional protein purification methods, such as ion exchange or hydrophobic interaction chromatography. Following either secondary purification approach, preparative size exclusion chromatography (SEC) can be used to polish and ensure conformational homogeneity, while buffer exchanging the 4 chain bispecifics. Final quality control should include analytical SEC, mass spectrometry, and in vito binding assessments with the different antigens to ensure the conformational and chemical integrity of the bispecific. See, e.g., J. B. Ridgway et al., Protein Eng. 9 (1996) 617-621. K. Gunasekaran et al., J. Biol. Chem. 285 (2010) 19637-19646. Preferred monomeric elements of the IgG1 1+1 heterodimers described herein each contain certain LC and HC constant region sequences discussed supra and identified herein to reduce propensity for homodimer formation during production of the IgG1 1+1 heterodimer format.

Parental Anti-CD47 Antibody CL-4033 for Detuned OMT Derived Species

Also provided is an anti-CD47 antibody comprising a VL region comprising VL CDR1 RASQGISSWLA (SEQ ID NO:893), VL CDR2 AASVLES (SEQ ID NO:894), VL CDR3 QQANSFPYT (SEQ ID NO:895); and, a variable heavy chain (VH) comprising VH CDR1 NFVMS (SEQ ID NO:896), VH CDR2 TISGSGGSTYYADSVKG (SEQ ID NO:897), and VH CDR3 HHILRYFD (SEQ ID NO:898). Also provided is an anti-CD47 antibody comprising a VL region comprising SEQ ID NO: 891 and a VH region comprising SEQ ID NO: 892. Anti-CD47 antibody CL-4033 is the parental antibody for detuned OMT derived anti-CD47 VL/VH Fabs described herein. See Example 2.

Antibodies comprising a VL region comprising SEQ ID NO: 891 and a VH region comprising SEQ ID NO: 892 and/or VL CDR1 (SEQ ID NO:893), VL CDR2 (SEQ ID NO:894), VL CDR3 (SEQ ID NO:895); and, VH CDR1 (SEQ ID NO:896), VH CDR2 (SEQ ID NO:897), and VH CDR3 (SEQ ID NO:898) can be of any type (e.g., IgG, IgE, IgM, IgD, IgA or IgY), any class, (e.g., IgG1, IgG2, IgG3, IgG4, IgGA1 or IgGA2), or any subclass (e.g., IgG2a or IgG2b) of immunoglobulin molecule.

In addition, the current invention is directed to a pharmaceutical composition for the control of tumor cells, for administration to a patient in need thereof, comprising an anti-CD47 antibody described herein.

In addition, the current invention is directed to a pharmaceutical composition for the treatment of a B-cell disorder or a B-cell malignancy, for administration to a patient in need thereof, comprising an anti-CD47 antibody described herein.

The invention is further directed to a method of controlling tumor cells comprising administering an effective amount of an antibody described herein to a patient in need thereof.

The invention is further directed to a method treatment of a B-cell disorder or a B-cell malignancy comprising administering an effective amount of an antibody described herein to a patient in need thereof.

EXAMPLES

Example 1: Detuning of CC-90002

Rational design to decrease the affinity of the non-detuned parental version of CC-90002 (408_437) anti-CD47 arm was enabled with a crystal structure of an anti-CD47 Fab bound to the extra cellular domain of CD47. The epitope bound by CC-90002 is identical to that of original murine anti-CD47 2A1 bound to human CD47. See U.S. Pat. No. 9,045,541.

The variable domains of 2A1 were humanized and the final antibody was named "QN" composed of HC_2.3Q and LC_N, which ultimately was developed as an IgG4 P/E format (CC-90002). QN was further modified by the introduction of residues into the variable heavy domain for improved cell-free expression, this HC variant was named "HC_Q_5_MUT". The HC_Q_5_MUT HC and LC_N were further modified to decrease their immunogenicity using in silico modeling and in silico prediction of immunogenicity, these were collectively referred to as "CD47 2.0". Further variants in the variable heavy and variable light domains of CD47 2.0 LC_1147_2 and CD47 2.0 HC_434 were designed for improved pharmacokinetics, these were referred to as "CD47 3.0". WO2016109415 (US.20170369572); WO2018009499 (US.20190241654); and WO2018183182, each of which are herein incorporated by reference.

The anti-CD47 epitope covers a large surface area and residues from both the light chain (LC) and the heavy chain (HC) participate in the interaction.

To decrease the affinity of the anti-CD47 arm for CD47, CD47 interacting residues from both the LC and HC were subjected to in silico mutagenesis using the "Residue Scan" module from the Molecular Operating Environment (MOE) modeling program. This process created a library of thousands of variants with a wide range of predicted affinities. Each in silico Fab variant was modeled to calculate a predicted change in stability (dStability) or a change in affinity for the CD47 ECD (dAffinity). Over 5,000 variants with positive dAffinity scores (predicted to have lower affinity relative to the parental Fab) and negative dStability (predicted to have higher stability than the parental Fab) were analyzed using immunogenicity assessment software to identify variants that would be predicted to have low immunogenicity. Of these, 143 low immunogenic risk Fab variants with predicted Kds for CD47 ranging from 10 nM to 1 mM, were selected for cell based testing.

To screen target-cell selective anti-CD47 Fabs, the selected anti-CD47 Fab variants were constructed as IgG1 fusions and paired with the anti-EGFR arm from cetuximab. The proper assembly of the 4 chain bispecific was enabled by the presence of Fab and Fc substitutions described herein present in all 4 chains. The 4 chain bispecifics containing the 143 selected variants were transiently expressed in Expi-CHO cells and the bispecifics were purified in a single step using magnetic protein A beads. To identify the target-cell selective bispecifics, the variants were tested with two experiments. The first experiment measured the ability of the detuned anti-CD47×anti-EGFR bispecifics to bind to the non-target Raji cell line that expressed the CD47 antigen, but not the EGFR antigen. The second experiment measured the ability of the detuned anti-CD47×anti-EGFR bispecifics to block SIRPα binding to the target Fadu cell line that expressed the CD47 antigen and the EGFR antigen. These experiments yielded a set of 8 variants that showed a 10-fold to 20-fold decreased affinity for the non-target CD47+/EGFR-Raji cell line relative to the non-detuned anti-CD47×anti-EGFR parental antibody, and yet was still able to block 75-90% SIRPα binding to the CD47+/EGFR+ Fadu target cell line.

The rituximab anti-CD20 arm was paired with the 8 detuned anti-CD47 variants similarly using an IgG1 Fc. It was observed that the detuned CD47×CD20 bispecifics had reduced binding to the CD47+/CD20− non-target Fadu cell line relative to the non-detuned CD47×CD20 parental antibody, and yet were still able to block 75-90% of SIRPα binding to the target Raji cell line which was CD47 and CD20 positive.

Additional developability assessments of the variants led to the selection of a single anti-CD47 Fab variant, VH E59Y/S102E, which was cloned into three CC-90002 derived frameworks, for pharmacokinetic testing in cynomolgus monkeys: TPP-1367, TPP-1360, and TPP-1361.

Example 2: Description of OMT Derived Detuning and Description of Screen to Identify Favored Variants OmniRat animals were immunized with the extra-cellular domain (ECD) of human CD47. OmniRat animals are transgenic animals that express human light and heavy chain repertoires, such that the antibodies produced in response to immunization contain fully human sequences. From this immunization campaign, one antibody, designated M2, was discovered that appeared to meet the required functional attributes. To develop M2 further, 37 variants were made in the light chain CDRL2 of M2 in an attempt to reduce its potential immunogenicity. These were expressed in a 24 well format and the supernatants were screened for binding to human CD47 using a Biacore 8K instrument. From these 37 variants, 11 were selected for further development based upon preservation of function, expressability, and predicted low immunogenicity. From these eleven variants, one antibody, designated CL-4033, was selected for detuning.

A homology model of CL-4033 was constructed and a library of variants that would be predicted to have a range of lower affinities, with good stability, and low immunogenicity were designed. 64 of the detuned CL-4033 variants were then paired with the anti-CD20 rituximab arm comprised of substitutions designed to reduce homodimer formation as described herein and were expressed transiently in ExpiCHO, purified, and analyzed for binding to Fadu cells, which express CD47 but not CD20. Ten variants that showed low binding to Fadu cells were then tested for their ability to block human SIRPα binding to Raji cells. One variant, CL-4033-H100Y, demonstrated the greatest amount of human SIRPα blocking to the Raji target cells and had weak affinity for the non-target Fadu cells. This variant was designated TPP-1362.

Example 3: Summary of SPR Binding Results for Binding of Rituximab to CD20

Since the CD20 antigen cannot be purified for in vitro binding experiments, i.e. SPR anti-CD20 affinity measurements are performed on cells. An example effective concentration for 50% ($EC_{50}$) binding of rituximab to Raji cells (CD20+/CD47+) was found to be around 1.1 nM according to FIG. 17.

Example 4: Summary of SPR Binding Results for Bispecific Entities Described Herein Surface Plasmon Resonance (SPR) experiments were used to measure the affinities of TPP-1360 and TPP-1362 to CD47. These two antibodies were tested for binding to human CD47 and cynomolgus CD47, and were found to not bind to mouse CD47. TPP-1360 was measured to have an affinity for human CD47 ECD of 1.7 µM Kd, which reflects ~350× decrease in affinity relative to the parental anti-CD47 binder. The TPP-1360 affinity for the cynomolgus CD47 ECD was found to be 4.51 µM Kd. TPP-1362 was measured to have an affinity for human CD47 ECD of 0.796 µM Kd, which reflects ~150× decrease in affinity relative to the parental anti-CD47 binder. The TPP-1362 affinity for the cynomolgus CD47 ECD was found to be 2.06 µM Kd. Finally, in addition to the measured affinities, a sandwich SPR assay demonstrated that both bound CD47 and CD20 simultaneously.

Example 5: Dose Response of Binding and SIRPα Blocking of Example Bispecific Entities Dose response curves for TPP-1360 and TPP-1362 blocking of human SIRPα binding to various CD20 expressing non-Hodgkins lymphoma tumor cell lines were generated. Cell lines were incubated with increasing concentrations of either bispecific, then human SIRPα was added at a saturating concentration. In addition to the bispecific, rituximab and the parental anti-CD47 binder (TPP-23 which is CD47 2.0 408_437 with IgG1) were included for reference.

Cells were washed then incubated with a secondary antibody to measure the amount of SIRPα bound to the tumor cells. For cell line OCI-Ly3 (a DLBCL cell line), TPP-1360 was found to have an EC50=1.30 nM and TPP-1362 was found to have an EC50=0.70 nM. For the Raji cell line (a B-lymphocyte Burkitt's lymphoma cell line) TPP-1360 was found to have an EC50=1.64 nM and TPP-1362 was found to have an EC50=1.10 nM. The parental anti-CD47, TPP-23, was found to have an $EC_{50}$ of 0.11 nM for blocking human SIRPα binding to OCI-Ly3 cells as shown in FIG. 21. Rituximab had no effect on SIRPα binding.

Example 6: Dose Response for Phagocytosis

Dose response curves for TPP-1360 and TPP-1362 activation of phagocytosis towards various CD20 expressing non-Hodgkins lymphoma tumor cell lines were generated. Human monocytes were differentiated into macrophages, which were then added to tumor cell lines that had been incubated with increasing concentrations of either bispecific. In addition to the bispecific entities, rituximab and the parental anti-CD47 binder (TPP-23) were included for reference. Fluorescence labeling of macrophages and tumor cells was used to measure the number of phagocytic events using an image based quantification method. For the OCI-Ly3 cell line, TPP-1360 was found to have an EC50=1.4 nM and TPP-1362 was found to have an EC50=0.43 nM. For the Raji cell line, TPP-1360 was found to have an EC50=1.8 nM and TPP-1362 was found to have an EC50=0.37 nM.

Example 7: Binding Studies with Human and Cyno RBCs and Hemagluttination

Binding of certain bispecific entity examples to human and cynomolgus monkey RBCs was determined to assess their non-target cell binding potential. RBCs were isolated from whole blood and were incubated with increasing concentrations of the example bispecifics. Binding was expressed as a percentage of the amount of binding observed at 2 µg/ml of the parental anti-CD47 binder (TPP-23). At 200 µg/ml, TPP-1360 and TPP-1361 bound to <1% of that seen for the parental anti-CD47 binding to human RBCs. Similarly, at 200 µg/ml, TPP-1360 bound to <1% of that seen for the parental anti-CD47 binding to cynomolgus RBCs. A higher degree of binding was observed for TPP-1362 binding to cynomolgus RBCs at 200 µg/ml, which showed a binding of 2-3% of the parental anti-CD47 binder. Finally, the parental anti-CD47 binders for both leads demonstrated no hemagluttination of human RBCs at 200 µg/ml. Similarly, both TPP-1360 and TPP-1361 showed no hemagluttination at 200 µg/ml. BRIC6, a known hemagluttinating antibody was used as a positive control.

Example 8: Binding Studies to Human PBMCs and Whole Blood

Binding of the bispecific entity species described herein to human Peripheral Blood Mononuclear Cells (PBMCs) was assessed. Relative to the parental anti-CD47 binder TPP-23 and rituximab, the TPP-1360 bispecific showed less binding to all cell types with the exception of the B-cells, which showed significant binding through the presence of the anti-CD20 Fab portion.

Example 9: First Round Lead Cynomolgus PK

A cynomolgus PK experiment was carried out with example bispecific entity species described herein. Cynomolgus monkeys were dosed twice at 20 mg/kg, on day 1 and day 15. B-cell depletion was observed. From these studies TPP-1360 and TPP-1362 were chosen for further study in a cynomolgus monkey exploratory toxicology (E-tox) study, as described in Example 10.

Example 10: Second Round Lead Cynomolgus E-Tox

A cynomolgus E-tox experiment was carried out with TPP-1360, and TPP-1362. For TPP-1360, cynomolgus monkeys were dosed at 100, 20, and 10 mg/kg, once a week for two weeks, which was followed by a non-dosing period of 2 weeks. A second TPP-1360 arm, tested 10 mg/kg twice a week for two weeks, which was also followed by a two week non-dosing period. For TPP-1362, cynomolgus monkeys were dosed at 60, 20, and 10 mg/kg, once a week for two weeks, which was followed by a non-dosing period of 2 weeks. A second TPP-1362 arm, tested 10 mg/kg twice a week for two weeks, which was also followed by a two week non-dosing period, twice at 20 mg/kg, on day 1 and day 15. These studies showed that TPP-1360 was well tolerated, showed deep B-cell depletion, and achieved dose-proportional exposure, confirming the avoidance of sink thus the target-cell selective.

Example 11: In Vitro Pharmacology

A. Human Whole Blood Binding

To assess the specificity of TPP-1360, its binding profile was first evaluated in whole blood using flow cytometry. Across two donors, 200 nM TPP-1360 substantially shifted the binding signal to B cells and rather weakly to T cells, monocytes, and NK cells, with minimal or no binding to platelets or red blood cells thereby illustrating selective binding to B cells in human whole blood. See, FIG. 7.

FIG. 7 shows that the bispecific TPP-1360, for example, binds primarily to B cells, with a very small amount of binding to the other cell types listed possibly because of higher levels of CD47 than what is found on blood cells, or because of the contribution of the Fc which can engage Fc receptors which are expressed on NK cells and monocytes. Conversely TPP-23, a high affinity CD47 monospecific antibody binds to all of these cell types due to the ubiquitous expression of CD47 and the high affinity for CD47 found in TPP-23.

The overall binding profile of TPP-1360 in human whole blood is similar to rituximab. Conversely, the parental CD47 mAb, TPP-23, used as a control for CD47 expression, significantly bound to all cell populations in human blood.

B. Tumor Cell Binding

Furthermore, the RBC binding capacity of TPP-1360, for example, was extensively evaluated in purified human RBCs and in co-culture of human RBCs with tumor cells. As illustrated in FIG. 8, TPP-1360 selectively bound CD47$^+$/CD20$^+$ Raji Cells but not CD47$^+$/CD20-human RBCs. Moreover, in a co-culture of Raji cells and human RBCs, TPP-1360 displayed dose-dependent binding to CD47$^+$/CD20$^+$ Raji cells but no binding to human RBCs, even at concentration as high as 1 mg/mL. See, FIG. 9. To the contrary, the parental CD47 type/CD20 bispecific, TPP-2, significantly bound to both Raji cells and human RBCs. In addition, TPP-1360 does not show binding to purified cyno RBC from multiple donors.

C. SIRPα Competition

Having demonstrated its selective binding to CD20$^+$/CD47$^+$ cells, an assessment was made of the ability of TPP-1360 to antagonize human SIRPα interaction with cell surface CD47 using an in vitro competition assay. TPP-1360 potently blocked recombinant human SIRPα-Fc binding to human CD47 expressed on the surface of CD20$^+$/CD47$^+$ lymphoma cell lines OCI-Ly3 and Raji, with average EC50 values of 1.30 nM and 1.64 nM, respectively. See, FIG. 10 and FIG. 11. FIG. 10 illustrates the fact that TPP-1360, for example, potently and completely blocked recombinant human SIRPα-Fc binding to human CD47 expressed on the surface of CD20$^+$/CD47$^+$ lymphoma cell line OCI-Ly3. FIG. 11 illustrates the fact that TPP-1360, for example, potently and completely blocked recombinant human SIRPα-Fc binding to human CD47 expressed on the surface of CD20$^+$/CD47$^+$ lymphoma cell line Raji. In contrast, neither rituximab nor control bispecific antibody TPP-1480 (anti-CD20/hen egg lysozyme) were able to compete with human SIRPα-Fc binding to the same cell lines. The data presented herein also demonstrates that TPP-1360 potency to block human SIRPα-CD47 interaction is lower than TPP-23 consistent with the attenuated affinity of TPP-1360 to human CD47.

Example 12: Functional Activities: Human Macrophage Phagocytosis

This Example demonstrates the capacity of TPP-1360 in triggering tumor phagocytosis, as determined in vitro by automated counting of "eaten" CD20+CD47 tumor cells inside of labeled macrophages.

Expression of CD20 and CD47 was first verified in each target tumor cell line (OCI-Ly3, Raji, REC-1, and RIVA) by quantifying antibody binding capacity (ABC) using a flow cytometric assay (Denny T N et al., Cytometry. 1996 December; 26(4):265-74). All four cell lines express high levels of CD47 and CD20. Table 1.

TABLE 1

CD47 and CD20 Antigen Expression on Lymphoma Cell Surface

| Cell Line | CD20 ABC | CD47 ABC |
| --- | --- | --- |
| OCI-Ly3 | 154,000 | 247,000 |
| REC-1 | 510,036 | 453,415 |
| RIVA | 722,000 | 443,000 |
| Raji | 522,596 | 213,927 |

ABC = Antibody binding capacity.

Next, titrated antibodies were added to pre-differentiated macrophages, followed by co-culture with carboxyfluorescein succinimidyl ester (CSFE)-labeled tumor cells opsonized with TPP-1360. Phagocytosis activity was quantitatively determined by the number of labeled tumor cells within the labeled macrophages. Green intensity (CFSE) was measured in each of the CD14 allophycocyanin (APC)-labeled macrophages, and a threshold gate was used to identify CFSE-positive macrophages. A threshold of approximately 1000 MFI (mean fluorescence intensity), with a variance of no more than a few hundred MFI was observed across the experiments. For each sample, the calculated percentage of phagocytosis was determined as: [(Number of CFSE-positive macrophages)/(number of total macrophage)]×100. Across at least two donors, treatment with TPP-1360 induced macrophage-mediated phagocytosis of four CD20+ malignant B cell lines. Representative data from one donor is shown in FIG. 12 (Raji cells), FIG. 13 (OCI-Ly3 cells), FIG. 14 (REC-1 cells), and FIG. 15 (RIVA cells). Area under the curve was calculated and followed by paired t test to determine statistical significance of TPP-1360 compared with rituximab. See, FIG. 16. The data demonstrates that treatment with TPP-1360 triggered significantly more efficient phagocytosis than rituximab in Raji and OCI-Ly3 cells, likely due to the concomitant blockade of the SIRPα-CD47 interaction and the engagement of activating receptors, such as FcγRs, by TPP-1360.

Example 13: Pharmacokinetics

To determine the pharmacokinetic (PK) profile of the bispecific entities (antibody species, TPP-1360, TPP-1361, TPP-1362 and TPP-1367 described herein, non-GLP studies were conducted in mice and cynomolgus monkeys. A single-dose mouse PK study was performed using naïve, female, NOD/SCID mice with 10 mg/kg of antibody administered via intraperitoneal (IP) injection. Sparse PK sampling (n=4 per timepoint) was performed over the course of 72 hours, and all animals showed detectable antibody species concentrations throughout study duration. The calculated half-life was 3.4 days but may be underestimated considering the sampling duration. To evaluate the PK profiles in cynomolgus monkeys, a repeat-dose exploratory toxicology study was performed, and 20 mg/kg of antibody species was administered via IV bolus injection on Day 1 and Day 15 to three naïve male monkeys. Following repeat-dosing of the antibody species, systemic exposure was achieved, and the antibody species was detectable in the serum of 2 of 3 monkeys throughout study duration (336 hr post Day 15 dose). Samples were also collected as part of the repeat-dose study for hematology and immunophenotyping assessments. The observed depletion of B-lymphocytes demonstrates drug functionality in vivo. Overall, antibody species exposure was maintained throughout study duration in both the single-dose mouse and repeat-dose monkey studies with similar half-lives ranging from 3-3.5 days reported between the two studies.

Example 14: Safety Profile

This example series of highly evaluated species exhibit acceptable toxicology profile, e.g., well tolerated up to 100 mg/kg QW, the highest dose tested. Toxicokinetics were evaluated as part of a 28-day exploratory toxicology study in cynomolgus monkeys. TPP-1360 was administered either BIW or QW via IV injection to cynomolgus monkeys (4/group) at dose levels of 10 mg/kg (BIW) on Days 1, 4, 8, 11, and 15 or at 20 and 100 mg/kg (QW) on Days 1, 8, and 15. Serum concentrations were measured with a sandwich ELISA using an anti-rituximab antibody for capture and a goat anti-human IgG Fc for detection. Following multiple IV doses of 10, 20, or 100 mg/kg, systemic exposure of TPP-1360 was achieved at all dose levels and maintained by all animals throughout study duration. TPP-1360 exhibited linear TK with approximately dose proportional increases in $C_{max}$ and $AUC_{0-668}$ across the 20 and 100 mg/kg dose groups. After first dose, clearance was similar across the 10-100 mg/kg dose range, suggesting target saturation at 10 mg/kg dose. $R_{AUC}$ values indicate some TPP-1360 accumulation by Dose 5 and Dose 3 in the 10 (BIW) and 100 (QW) mg/kg dose groups, respectively. The mean calculated half-life ranged from 2-4 days depending on the dose level and dose regimen. Anti-drug antibody was detected in 5/8 animals tested at Day 15 prior to dose and in 5/6 animals tested on study Day 29. Anti-drug antibodies did affect the exposure of TPP-1360 as evidenced by an observed decrease in exposure for ADA positive animals. TPP-1360 was well-tolerated up to 100 mg/kg QW, the highest dose tested. Decreases in B cells in the peripheral blood and in multiple lymphoid tissues were seen at 10 mg/kg BIW and 2 20 mg/kg QW, demonstrating robust pharmacodynamic activity. Dosing 10 mg/kg BIW did not provide added benefit over 20 mg/kg QW. In addition to effects on B cells, TPP-1360 also decreased T cells and NK cells at all dose levels, neutrophils at ≥20 mg/kg QW and red blood cells at 100 mg/kg QW. However, no test article-related decrease of platelets was observed. Decreases in T cells, NK cells, neutrophils and red blood cells are believed to be mediated by the CD47 arm of TPP-1360, since these cells do not express CD20.

Example 15: Immunogenicity

The Interactive Screening and Protein Reengineering Interface (ISPRI) software, developed by EpiVax, is an in silico computational method used to assess potential antibody immunogenicity in humans, and is known to be a clinically well-established T cell-dependent analysis tool (FIG. 18). The VH and VL amino acid sequences of TPP-1360 were analyzed for putative T effector and T regulatory hotspots and were found to have a low risk for immunogenicity.

Example 16: Rail Xenograft Model

CD47×CD20 bispecific entities described herein demonstrate better efficacy than rituximab in vivo in a Raji NOD-SCID model. The purpose of this study was to determine the single agent antitumor activity of TPP-1360 or TPP-1362 in a Raji xenograft model expressing lower levels of CD20 and higher levels of CD47. Female NOD-SCID mice were inoculated with Raji cells in the right flank. Dosing was initiated when the tumors were approximately 270 mm$^3$ in size. TPP-1360 and TPP-1362 were tested at 10 and 30 mg/kg with a once a week (QW) dosing for 2 weeks. Rituximab which is bivalent to CD20 was used as a comparator with the same dosing paradigm. The final tumor volume reduction was determined on Day 25 at the time of the termination of the study when the mean tumor volumes in the isotype control (anti-RSV IgG1) group reached approximately 2000 mm$^3$. Significant (p<0.0001) antitumor activity of TPP-1360 with a tumor volume reduction of 52% was observed at both 10 and 30 mg/kg, QW, and also significant antitumor activity of TPP-1362 with a tumor reduction of 62% was observed at 10 mg/kg QW or 64% at 30 mg/kg QW. (FIGS. 19-20) In the same dosing regimen, rituximab showed a 33% and 38% tumor volume reduction at 30 and 10 mg/kg, respectively. The antitumor activity of TPP-1360 at 30 mg/kg, QW was significantly (p<0.01) better than rituximab at corresponding dose level, suggesting the contribution of CD47 arm in the antitumor activity of TPP-1360. The antitumor activity of TPP-1362 at 30 mg/kg, QW was also significantly (p<0.0001) better than rituximab at corresponding dose level, suggesting the contribution of CD47 arm in the antitumor activity of TPP-1362. There was no significant body weight loss in the animals treated with isotype control, TPP-1360, TPP-1362 or rituximab.

TABLE 2

Sequence Listing

| SEQ ID NO: | Description | Amino Acid Sequence |
|---|---|---|
| 1 | CG_64_VL | NIQMTQSPSSLSASVGDRVTITCRASQDIHRYLSWFQQKPGKVPKHLIYRANR LVSGVPSRFSGSGSGTEFTLTISSLQPEDFATYYCLQYAEFPYTFGGGTKVEIK |
| 2 | CG_64_VH | QMQLVQSGAEVKKPGSSVKVSCKASGFNIKDYYLHWVRQAPGKGLEWMGYI DPEQGDTEYAQKFQGRVTITRDRSTSTAYMELRSLRAEDTAVYYCNAAYGSSS YPMDYWGQGTLVTVSS |
| 3 | CG_65_VL | NIQMTQSPSSLSASVGDRVTITCRASQDIHRYLSWFQQKPGKVPKHLIYRANR LVSGVPSRFSGSGSGTEFTLTISSLQPEDFATYYCLQYQEFPYTFGGGTKVEIK |
| 4 | CG_65_VH | QMQLVQSGAEVKKPGSSVKVSCKASGFNIKDYYLHWVRQAPGKGLEWMGYI DPTQGDTHYAQKFQGRVTITRDRSTSTAYMELRSLRAEDTAVYYCNAAYGSSS YPMDYWGQGTLVTVSS |
| 5 | CG_66_VL | NIQMTQSPSSLSASVGDRVTITCRASQDIHRYLSWFQQKPGKVPKHLIYRANR LVSGVPSRFSGSGSGTEFTLTISSLQPEDFATYYCLQYEEFPYTFGGGTKVEIK |
| 6 | CG_66_VH | QMQLVQSGAEVKKPGSSVKVSCKASGFNIKDYYLHWVRQAPGKGLEWMGYI DPSQGDTVYAQKFQGRVTITRDRSTSTAYMELRSLRAEDTAVYYCNAAYGSSS YPMDYWGQGTLVTVSS |
| 7 | CG_67_VL | NIQMTQSPSSLSASVGDRVTITCRASQDIHDYLSWFQQKPGKVPKHLIYRANIL VSGVPSRFSGSGSGTEFTLTISSLQPEDFATYYCLQYDEFPYTFGGGTKVEIK |
| 8 | CG_67_VH | QMQLVQSGAEVKKPGSSVKVSCKASGFNIKDYYLHWVRQAPGKGLEWMG WIYPDQGVTEYAQKFQGRVTITRDRSTSTAYMELRSLRAEDTAVYYCNAAYGS SSYPMDYWGQGTLVTVSS |
| 9 | CG_68_VL | NIQMTQSPSSLSASVGDRVTITCRASQDIHDYLSWFQQKPGKVPKHLIYRANLL VSGVPSRFSGSGSGTEFTLTISSLQPEDFATYYCLQYDEFPYTFGGGTKVEIK |
| 10 | CG_68_VH | QMQLVQSGAEVKKPGSSVKVSCKASGFNIKDYYLHWVRQAPGKGLEWMG WIEPDQGATEYAQKFQGRVTITRDRSTSTAYMELRSLRAEDTAVYYCNAAYGS SSYPMDYWGQGTLVTVSS |
| 11 | CG_69_VL | NIQMTQSPSSLSASVGDRVTITCRASQDIHDYLSWFQQKPGKVPKHLIYRANY LVSGVPSRFSGSGSGTEFTLTISSLQPEDFATYYCLQYDEFPYTFGGGTKVEIK |
| 12 | CG_69_VH | QMQLVQSGAEVKKPGSSVKVSCKASGFNIKDYYLHWVRQAPGKGLEWMG WIHPDQGITEYAQKFQGRVTITRDRSTSTAYMELRSLRAEDTAVYYCNAAYGS SSYPMDYWGQGTLVTVSS |
| 13 | CG_70_VL | NIQMTQSPSSLSASVGDRVTITCRASQDIHEYLSWFQQKPGKVPKHLIYRANA LVSGVPSRFSGSGSGTEFTLTISSLQPEDFATYYCLQYDEFPYTFGGGTKVEIK |

TABLE 2-continued

Sequence Listing

| SEQ ID NO: | Description | Amino Acid Sequence |
|---|---|---|
| 14 | CG_70_VH | QMQLVQSGAEVKKPGSSVKVSCKASGFNIKDYYLHWVRQAPGKGLEWMG<br>WILPDQGVTEYAQKFQGRVTITRDRSTSTAYMELRSLRAEDTAVYYCNAAYGS<br>SSYPMDYWGQGTLVTVSS |
| 15 | CG_71_VL | NIQMTQSPSSLSASVGDRVTITCRASQDIHEYLSWFQQKPGKVPKHLIYRANIL<br>VSGVPSRFSGSGSGTEFTLTISSLQPEDFATYYCLQYDEFPYTFGGGTKVEIK |
| 16 | CG_71_VH | QMQLVQSGAEVKKPGSSVKVSCKASGFNIKDYYLHWVRQAPGKGLEWMG<br>WIEPDQGITEYAQKFQGRVTITRDRSTSTAYMELRSLRAEDTAVYYCNAAYGS<br>SSYPMDYWGQGTLVTVSS |
| 17 | CG_72_VL | NIQMTQSPSSLSASVGDRVTITCRASQDIHEYLSWFQQKPGKVPKHLIYRANLL<br>VSGVPSRFSGSGSGTEFTLTISSLQPEDFATYYCLQYDEFPYTFGGGTKVEIK |
| 18 | CG_72_VH | QMQLVQSGAEVKKPGSSVKVSCKASGFNIKDYYLHWVRQAPGKGLEWMG<br>WILPDQGITEYAQKFQGRVTITRDRSTSTAYMELRSLRAEDTAVYYCNAAYGSS<br>SYPMDYWGQGTLVTVSS |
| 19 | CG_73_VL | NIQMTQSPSSLSASVGDRVTITCRASQDIHEYLSWFQQKPGKVPKHLIYRANQ<br>LVSGVPSRFSGSGSGTEFTLTISSLQPEDFATYYCLQYDEFPYTFGGGTKVEIK |
| 20 | CG_73_VH | QMQLVQSGAEVKKPGSSVKVSCKASGFNIKDYYLHWVRQAPGKGLEWMG<br>WIIPDQGMTEYAQKFQGRVTITRDRSTSTAYMELRSLRAEDTAVYYCNAAYGS<br>SSYPMDYWGQGTLVTVSS |
| 21 | CG_74_VL | NIQMTQSPSSLSASVGDRVTITCRASQDIHEYLSWFQQKPGKVPKHLIYRANVL<br>VSGVPSRFSGSGSGTEFTLTISSLQPEDFATYYCLQYDEFPYTFGGGTKVEIK |
| 22 | CG_74_VH | QMQLVQSGAEVKKPGSSVKVSCKASGFNIKDYYLHWVRQAPGKGLEWMG<br>WIMPDQGLTEYAQKFQGRVTITRDRSTSTAYMELRSLRAEDTAVYYCNAAYG<br>SSSYPMDYWGQGTLVTVSS |
| 23 | CG_75_VL | NIQMTQSPSSLSASVGDRVTITCRASQDIHEYLSWFQQKPGKVPKHLIYRANYL<br>VSGVPSRFSGSGSGTEFTLTISSLQPEDFATYYCLQYDEFPYTFGGGTKVEIK |
| 24 | CG_75_VH | QMQLVQSGAEVKKPGSSVKVSCKASGFNIKDYYLHWVRQAPGKGLEWMG<br>WIMPDQGITEYAQKFQGRVTITRDRSTSTAYMELRSLRAEDTAVYYCNAAYGS<br>SSYPMDYWGQGTLVTVSS |
| 25 | CG_76_VL | NIQMTQSPSSLSASVGDRVTITCRASQDIHIYLSWFQQKPGKVPKHLIYRANDL<br>VSGVPSRFSGSGSGTEFTLTISSLQPEDFATYYCLQYDEFPYTFGGGTKVEIK |
| 26 | CG_76_VH | QMQLVQSGAEVKKPGSSVKVSCKASGFNIKDYYLHWVRQAPGKGLEWMG<br>WIMPDQGMTEYAQKFQGRVTITRDRSTSTAYMELRSLRAEDTAVYYCNAAY<br>GSSSYPMDYWGQGTLVTVSS |
| 27 | CG_77_VL | NIQMTQSPSSLSASVGDRVTITCRASQDIHIYLSWFQQKPGKVPKHLIYRANTL<br>VSGVPSRFSGSGSGTEFTLTISSLQPEDFATYYCLQYDEFPYTFGGGTKVEIK |
| 28 | CG_77_VH | QMQLVQSGAEVKKPGSSVKVSCKASGFNIKDYYLHWVRQAPGKGLEWMG<br>WIYPDQGMTEYAQKFQGRVTITRDRSTSTAYMELRSLRAEDTAVYYCNAAYG<br>SSSYPMDYWGQGTLVTVSS |
| 29 | CG_78_VL | NIQMTQSPSSLSASVGDRVTITCRASQDIHLYLSWFQQKPGKVPKHLIYRANDL<br>VSGVPSRFSGSGSGTEFTLTISSLQPEDFATYYCLQYDEFPYTFGGGTKVEIK |
| 30 | CG_78_VH | QMQLVQSGAEVKKPGSSVKVSCKASGFNIKDYYLHWVRQAPGKGLEWMG<br>WIQPDQGLTEYAQKFQGRVTITRDRSTSTAYMELRSLRAEDTAVYYCNAAYGS<br>SSYPMDYWGQGTLVTVSS |
| 31 | CG_79_VL | NIQMTQSPSSLSASVGDRVTITCRASQDIHLYLSWFQQKPGKVPKHLIYRANEL<br>VSGVPSRFSGSGSGTEFTLTISSLQPEDFATYYCLQYDEFPYTFGGGTKVEIK |
| 32 | CG_79_VH | QMQLVQSGAEVKKPGSSVKVSCKASGFNIKDYYLHWVRQAPGKGLEWMG<br>WIEPDQGYTEYAQKFQGRVTITRDRSTSTAYMELRSLRAEDTAVYYCNAAYGS<br>SSYPMDYWGQGTLVTVSS |
| 33 | CG_80_VL | NIQMTQSPSSLSASVGDRVTITCRASQDIHNYLSWFQQKPGKVPKHLIYRANE<br>LVSGVPSRFSGSGSGTEFTLTISSLQPEDFATYYCLQYDEFPYTFGGGTKVEIK |
| 34 | CG_80_VH | QMQLVQSGAEVKKPGSSVKVSCKASGFNIKDYYLHWVRQAPGKGLEWMG<br>WILPDQGYTEYAQKFQGRVTITRDRSTSTAYMELRSLRAEDTAVYYCNAAYGS<br>SSYPMDYWGQGTLVTVSS |

TABLE 2-continued

Sequence Listing

| SEQ ID NO: | Description | Amino Acid Sequence |
|---|---|---|
| 35 | CG_81_VL | NIQMTQSPSSLSASVGDRVTITCRASQDIHNYLSWFQQKPGKVPKHLIYRANV<br>LVSGVPSRFSGSGSGTEFTLTISSLQPEDFATYYCLQYDEFPYTFGGGTKVEIK |
| 36 | CG_81_VH | QMQLVQSGAEVKKPGSSVKVSCKASGFNIKDYYLHWVRQAPGKGLEWMG<br>WIFPDQGMTEYAQKFQGRVTITRDRSTSTAYMELRSLRAEDTAVYYCNAAYG<br>SSSYPMDYWGQGTLVTVSS |
| 37 | CG_82_VL | NIQMTQSPSSLSASVGDRVTITCRASQDIHQYLSWFQQKPGKVPKHLIYRAND<br>LVSGVPSRFSGSGSGTEFTLTISSLQPEDFATYYCLQYDEFPYTFGGGTKVEIK |
| 38 | CG_82_VH | QMQLVQSGAEVKKPGSSVKVSCKASGFNIKDYYLHWVRQAPGKGLEWMG<br>WIYPDQGITEYAQKFQGRVTITRDRSTSTAYMELRSLRAEDTAVYYCNAAYGSS<br>SYPMDYWGQGTLVTVSS |
| 39 | CG_83_VL | NIQMTQSPSSLSASVGDRVTITCRASQDIHQYLSWFQQKPGKVPKHLIYRANE<br>LVSGVPSRFSGSGSGTEFTLTISSLQPEDFATYYCLQYDEFPYTFGGGTKVEIK |
| 40 | CG_83_VH | QMQLVQSGAEVKKPGSSVKVSCKASGFNIKDYYLHWVRQAPGKGLEWMG<br>WIFPDQGQTEYAQKFQGRVTITRDRSTSTAYMELRSLRAEDTAVYYCNAAYGS<br>SSYPMDYWGQGTLVTVSS |
| 41 | CG_84_VL | NIQMTQSPSSLSASVGDRVTITCRASQDIHTYLSWFQQKPGKVPKHLIYRAND<br>LVSGVPSRFSGSGSGTEFTLTISSLQPEDFATYYCLQYDEFPYTFGGGTKVEIK |
| 42 | CG_84_VH | QMQLVQSGAEVKKPGSSVKVSCKASGFNIKDYYLHWVRQAPGKGLEWMG<br>WIYPDQGLTEYAQKFQGRVTITRDRSTSTAYMELRSLRAEDTAVYYCNAAYGS<br>SSYPMDYWGQGTLVTVSS |
| 43 | CG_85_VL | NIQMTQSPSSLSASVGDRVTITCRASQDIHTYLSWFQQKPGKVPKHLIYRANYL<br>VSGVPSRFSGSGSGTEFTLTISSLQPEDFATYYCLQYDEFPYTFGGGTKVEIK |
| 44 | CG_85_VH | QMQLVQSGAEVKKPGSSVKVSCKASGFNIKDYYLHWVRQAPGKGLEWMG<br>WIHPDQGLTEYAQKFQGRVTITRDRSTSTAYMELRSLRAEDTAVYYCNAAYGS<br>SSYPMDYWGQGTLVTVSS |
| 45 | CG_86_VL | NIQMTQSPSSLSASVGDRVTITCRASQDIHVYLSWFQQKPGKVPKHLIYRAND<br>LVSGVPSRFSGSGSGTEFTLTISSLQPEDFATYYCLQYDEFPYTFGGGTKVEIK |
| 46 | CG_86_VH | QMQLVQSGAEVKKPGSSVKVSCKASGFNIKDYYLHWVRQAPGKGLEWMG<br>WIHPDQGVTEYAQKFQGRVTITRDRSTSTAYMELRSLRAEDTAVYYCNAAYGS<br>SSYPMDYWGQGTLVTVSS |
| 47 | CG_87_VL | NIQMTQSPSSLSASVGDRVTITCRASQDIHYYLSWFQQKPGKVPKHLIYRAND<br>LVSGVPSRFSGSGSGTEFTLTISSLQPEDFATYYCLQYDEFPYTFGGGTKVEIK |
| 48 | CG_87_VH | QMQLVQSGAEVKKPGSSVKVSCKASGFNIKDYYLHWVRQAPGKGLEWMG<br>WIYPDQGATEYAQKFQGRVTITRDRSTSTAYMELRSLRAEDTAVYYCNAAYGS<br>SSYPMDYWGQGTLVTVSS |
| 49 | CG_88_VL | NIQMTQSPSSLSASVGDRVTITCRASQDIHVYLSWFQQKPGKVPKHLIYRANQ<br>LVSGVPSRFSGSGSGTEFTLTISSLQPEDFATYYCLQYDEFPYTFGGGTKVEIK |
| 50 | CG_88_VH | QMQLVQSGAEVKKPGSSVKVSCKASGFNIKDYYLHWVRQAPGKGLEWMG<br>WIYPDQGATEYAQKFQGRVTITRDRSTSTAYMELRSLRAEDTAVYYCNAAYGS<br>SSYPMDYWGQGTLVTVSS |
| 51 | CG_89_VL | NIQMTQSPSSLSASVGDRVTITCRASQDIHTYLSWFQQKPGKVPKHLIYRANYL<br>VSGVPSRFSGSGSGTEFTLTISSLQPEDFATYYCLQYDEFPYTFGGGTKVEIK |
| 52 | CG_89_VH | QMQLVQSGAEVKKPGSSVKVSCKASGFNIKDYYLHWVRQAPGKGLEWMG<br>WISPDQGSTEYAQKFQGRVTITRDRSTSTAYMELRSLRAEDTAVYYCNAAYGS<br>SSYPMDYWGQGTLVTVSS |
| 53 | CG_90_VL | NIQMTQSPSSLSASVGDRVTITCRASQDIHEYLSWFQQKPGKVPKHLIYRANYL<br>VSGVPSRFSGSGSGTEFTLTISSLQPEDFATYYCLQYDEFPYTFGGGTKVEIK |
| 54 | CG_90_VH | QMQLVQSGAEVKKPGSSVKVSCKASGFNIKDYYLHWVRQAPGKGLEWMG<br>WIMPDQGYTEYAQKFQGRVTITRDRSTSTAYMELRSLRAEDTAVYYCNAAYG<br>SSSYPMDYWGQGTLVTVSS |
| 55 | CG_91_VL | NIQMTQSPSSLSASVGDRVTITCRASQDIHLYLSWFQQKPGKVPKHLIYRANQ<br>LVSGVPSRFSGSGSGTEFTLTISSLQPEDFATYYCLQYDEFPYTFGGGTKVEIK |

TABLE 2-continued

Sequence Listing

| SEQ ID NO: | Description | Amino Acid Sequence |
|---|---|---|
| 56 | CG_91_VH | QMQLVQSGAEVKKPGSSVKVSCKASGFNIKDYYLHWVRQAPGKGLEWMG<br>WIIPDQGYTEYAQKFQGRVTITRDRSTSTAYMELRSLRAEDTAVYYCNAAYGSS<br>SYPMDYWGQGTLVTVSS |
| 57 | CG_92_VL | NIQMTQSPSSLSASVGDRVTITCRASQDIHVYLSWFQQKPGKVPKHLIYRANEL<br>VSGVPSRFSGSGSGTEFTLTISSLQPEDFATYYCLQYDEFPYTFGGGTKVEIK |
| 58 | CG_92_VH | QMQLVQSGAEVKKPGSSVKVSCKASGFNIKDYYLHWVRQAPGKGLEWMG<br>WIEPDQGMTEYAQKFQGRVTITRDRSTSTAYMELRSLRAEDTAVYYCNAAYG<br>SSSYPMDYWGQGTLVTVSS |
| 59 | CG_93_VL | NIQMTQSPSSLSASVGDRVTITCRASQDIHHYLSWFQQKPGKVPKHLIYRANY<br>LVSGVPSRFSGSGSGTEFTLTISSLQPEDFATYYCLQYDEFPYTFGGGTKVEIK |
| 60 | CG_93_VH | QMQLVQSGAEVKKPGSSVKVSCKASGFNIKDYYLHWVRQAPGKGLEWMG<br>WIAPDQGVTEYAQKFQGRVTITRDRSTSTAYMELRSLRAEDTAVYYCNAAYGS<br>SSYPMDYWGQGTLVTVSS |
| 61 | CG_94_VL | NIQMTQSPSSLSASVGDRVTITCRASQDIHVYLSWFQQKPGKVPKHLIYRANQ<br>LVSGVPSRFSGSGSGTEFTLTISSLQPEDFATYYCLQYDEFPYTFGGGTKVEIK |
| 62 | CG_94_VH | QMQLVQSGAEVKKPGSSVKVSCKASGFNIKDYYLHWVRQAPGKGLEWMG<br>WIVPDQGMTEYAQKFQGRVTITRDRSTSTAYMELRSLRAEDTAVYYCNAAYG<br>SSSYPMDYWGQGTLVTVSS |
| 63 | CG_95_VL | NIQMTQSPSSLSASVGDRVTITCRASQDIHTYLSWFQQKPGKVPKHLIYRANYL<br>VSGVPSRFSGSGSGTEFTLTISSLQPEDFATYYCLQYDEFPYTFGGGTKVEIK |
| 64 | CG_95_VH | QMQLVQSGAEVKKPGSSVKVSCKASGFNIKDYYLHWVRQAPGKGLEWMG<br>WIAPDQGITEYAQKFQGRVTITRDRSTSTAYMELRSLRAEDTAVYYCNAAYGS<br>SSYPMDYWGQGTLVTVSS |
| 65 | CG_96_VL | NIQMTQSPSSLSASVGDRVTITCRASQDIHIYLSWFQQKPGKVPKHLIYRANEL<br>VSGVPSRFSGSGSGTEFTLTISSLQPEDFATYYCLQYDEFPYTFGGGTKVEIK |
| 66 | CG_96_VH | QMQLVQSGAEVKKPGSSVKVSCKASGFNIKDYYLHWVRQAPGKGLEWMG<br>WIMPDQGATEYAQKFQGRVTITRDRSTSTAYMELRSLRAEDTAVYYCNAAYG<br>SSSYPMDYWGQGTLVTVSS |
| 67 | CG_97_VL | NIQMTQSPSSLSASVGDRVTITCRASQDIHYYLSWFQQKPGKVPKHLIYRANEL<br>VSGVPSRFSGSGSGTEFTLTISSLQPEDFATYYCLQYDEFPYTFGGGTKVEIK |
| 68 | CG_97_VH | QMQLVQSGAEVKKPGSSVKVSCKASGFNIKDYYLHWVRQAPGKGLEWMG<br>WIVPDQGITEYAQKFQGRVTITRDRSTSTAYMELRSLRAEDTAVYYCNAAYGS<br>SSYPMDYWGQGTLVTVSS |
| 69 | CG_98_VL | NIQMTQSPSSLSASVGDRVTITCRASQDIHHYLSWFQQKPGKVPKHLIYRAND<br>LVSGVPSRFSGSGSGTEFTLTISSLQPEDFATYYCLQYDEFPYTFGGGTKVEIK |
| 70 | CG_98_VH | QMQLVQSGAEVKKPGSSVKVSCKASGFNIKDYYLHWVRQAPGKGLEWMG<br>WIYPDQGITEYAQKFQGRVTITRDRSTSTAYMELRSLRAEDTAVYYCNAAYGSS<br>SYPMDYWGQGTLVTVSS |
| 71 | CG_99_VL | NIQMTQSPSSLSASVGDRVTITCRASQDIHYYLSWFQQKPGKVPKHLIYRANEL<br>VSGVPSRFSGSGSGTEFTLTISSLQPEDFATYYCLQYDEFPYTFGGGTKVEIK |
| 72 | CG_99_VH | QMQLVQSGAEVKKPGSSVKVSCKASGFNIKDYYLHWVRQAPGKGLEWMG<br>WIYPDQGVTEYAQKFQGRVTITRDRSTSTAYMELRSLRAEDTAVYYCNAAYGS<br>SSYPMDYWGQGTLVTVSS |
| 73 | CG_100_VL | NIQMTQSPSSLSASVGDRVTITCRASQDIHIYLSWFQQKPGKVPKHLIYRANDL<br>VSGVPSRFSGSGSGTEFTLTISSLQPEDFATYYCLQYDEFPYTFGGGTKVEIK |
| 74 | CG_100_VH | QMQLVQSGAEVKKPGSSVKVSCKASGFNIKDYYLHWVRQAPGKGLEWMG<br>WIEPDQGLTEYAQKFQGRVTITRDRSTSTAYMELRSLRAEDTAVYYCNAAYGS<br>SSYPMDYWGQGTLVTVSS |
| 75 | CG_101_VL | NIQMTQSPSSLSASVGDRVTITCRASQDIHYYLSWFQQKPGKVPKHLIYRAND<br>LVSGVPSRFSGSGSGTEFTLTISSLQPEDFATYYCLQYDEFPYTFGGGTKVEIK |
| 76 | CG_101_VH | QMQLVQSGAEVKKPGSSVKVSCKASGFNIKDYYLHWVRQAPGKGLEWMG<br>WILPDQGDTEYAQKFQGRVTITRDRSTSTAYMELRSLRAEDTAVYYCNAAYGS<br>SSYPMDYWGQGTLVTVSS |

TABLE 2-continued

Sequence Listing

| SEQ ID NO: | Description | Amino Acid Sequence |
|---|---|---|
| 77 | CG_102_VL | NIQMTQSPSSLSASVGDRVTITCRASQDIHVYLSWFQQKPGKVPKHLIYRAND LVSGVPSRFSGSGSGTEFTLTISSLQPEDFATYYCLQYDEFPYTFGGGTKVEIK |
| 78 | CG_102_VH | QMQLVQSGAEVKKPGSSVKVSCKASGFNIKDYYLHWVRQAPGKGLEWMG WIYPDQGSTEYAQKFQGRVTITRDRSTSTAYMELRSLRAEDTAVYYCNAAYGS SSYPMDYWGQGTLVTVSS |
| 79 | CG_103_VL | NIQMTQSPSSLSASVGDRVTITCRASQDIHIYLSWFQQKPGKVPKHLIYRANQL VSGVPSRFSGSGSGTEFTLTISSLQPEDFATYYCLQYDEFPYTFGGGTKVEIK |
| 80 | CG_103_VH | QMQLVQSGAEVKKPGSSVKVSCKASGFNIKDYYLHWVRQAPGKGLEWMG WIDPDQGATEYAQKFQGRVTITRDRSTSTAYMELRSLRAEDTAVYYCNAAYGS SSYPMDYWGQGTLVTVSS |
| 81 | CG_104_VL | NIQMTQSPSSLSASVGDRVTITCRASQDIHLYLSWFQQKPGKVPKHLIYRANDL VSGVPSRFSGSGSGTEFTLTISSLQPEDFATYYCLQYDEFPYTFGGGTKVEIK |
| 82 | CG_104_VH | QMQLVQSGAEVKKPGSSVKVSCKASGFNIKDYYLHWVRQAPGKGLEWMG WIQPDQGVTEYAQKFQGRVTITRDRSTSTAYMELRSLRAEDTAVYYCNAAYG SSSYPMDYWGQGTLVTVSS |
| 83 | CG_105_VL | NIQMTQSPSSLSASVGDRVTITCRASQDIHLYLSWFQQKPGKVPKHLIYRANEL VSGVPSRFSGSGSGTEFTLTISSLQPEDFATYYCLQYDEFPYTFGGGTKVEIK |
| 84 | CG_105_VH | QMQLVQSGAEVKKPGSSVKVSCKASGFNIKDYYLHWVRQAPGKGLEWMG WIIPDQGETEYAQKFQGRVTITRDRSTSTAYMELRSLRAEDTAVYYCNAAYGS SSYPMDYWGQGTLVTVSS |
| 85 | CG_106_VL | NIQMTQSPSSLSASVGDRVTITCRASQDIHDYLSWFQQKPGKVPKHLIYRANY LVSGVPSRFSGSGSGTEFTLTISSLQPEDFATYYCLQYDEFPYTFGGGTKVEIK |
| 86 | CG_106_VH | QMQLVQSGAEVKKPGSSVKVSCKASGFNIKDYYLHWVRQAPGKGLEWMG WIIPDQGTTEYAQKFQGRVTITRDRSTSTAYMELRSLRAEDTAVYYCNAAYGSS SYPMDYWGQGTLVTVSS |
| 87 | CG_107_VL | NIQMTQSPSSLSASVGDRVTITCRASQDIHTYLSWFQQKPGKVPKHLIYRANQ LVSGVPSRFSGSGSGTEFTLTISSLQPEDFATYYCLQYDEFPYTFGGGTKVEIK |
| 88 | CG_107_VH | QMQLVQSGAEVKKPGSSVKVSCKASGFNIKDYYLHWVRQAPGKGLEWMG WIIPDQGYTEYAQKFQGRVTITRDRSTSTAYMELRSLRAEDTAVYYCNAAYGSS SYPMDYWGQGTLVTVSS |
| 89 | CG_108_VL | NIQMTQSPSSLSASVGDRVTITCRASQDIHRYLSWFQQKPGKVPKHLIYRANR LVSGVPSRFSGSGSGTEFTLTISSLQPEDFATYYCLQYDEFPYTFGGGTKVEIK |
| 90 | CG_108_VH | QMQLVQSGAEVKKPGSSVKVSCKASGFNIKDYYLHWVRQAPGKGLEWMG WIDPDQGTYYAQKFQGRVTITRDRSTSTAYMELRSLRAEDTAVYYCNAAYG DSSYPMDYWGQGTLVTVSS |
| 91 | CG_109_VL | NIQMTQSPSSLSASVGDRVTITCRASQDIHRYLSWFQQKPGKVPKHLIYRANR LVSGVPSRFSGSGSGTEFTLTISSLQPEDFATYYCLQYDEFPYTFGGGTKVEIK |
| 92 | CG_109_VH | QMQLVQSGAEVKKPGSSVKVSCKASGFNIKDYYLHWVRQAPGKGLEWMG WIDPDQGDTQYAQKFQGRVTITRDRSTSTAYMELRSLRAEDTAVYYCNAAYG YSSYPMDYWGQGTLVTVSS |
| 93 | CG_110_VL | NIQMTQSPSSLSASVGDRVTITCRASQDIHRYLSWFQQKPGKVPKHLIYRANR LVSGVPSRFSGSGSGTEFTLTISSLQPEDFATYYCLQYDEFPYTFGGGTKVEIK |
| 94 | CG_110_VH | QMQLVQSGAEVKKPGSSVKVSCKASGFNIKDYYLHWVRQAPGKGLEWMG WIDPDQGDTLYAQKFQGRVTITRDRSTSTAYMELRSLRAEDTAVYYCNAAYGE SSYPMDYWGQGTLVTVSS |
| 95 | CG_111_VL | NIQMTQSPSSLSASVGDRVTITCRASQDIHRYLSWFQQKPGKVPKHLIYRANR LVSGVPSRFSGSGSGTEFTLTISSLQPEDFATYYCLQYDEFPYTFGGGTKVEIK |
| 96 | CG_111_VH | QMQLVQSGAEVKKPGSSVKVSCKASGFNIKDYYLHWVRQAPGKGLEWMG WIDPDQGDTVYAQKFQGRVTITRDRSTSTAYMELRSLRAEDTAVYYCNAAYG ESSYPMDYWGQGTLVTVSS |
| 97 | CG_112_VL | NIQMTQSPSSLSASVGDRVTITCRASQDIHRYLSWFQQKPGKVPKHLIYRANR LVSGVPSRFSGSGSGTEFTLTISSLQPEDFATYYCLQYDEFPYTFGGGTKVEIK |

TABLE 2-continued

Sequence Listing

| SEQ ID NO: | Description | Amino Acid Sequence |
|---|---|---|
| 98 | CG_112_VH | QMQLVQSGAEVKKPGSSVKVSCKASGFNIKDYYLHWVRQAPGKGLEWMG<br>WIDPQQGDTEYAQKFQGRVTITRDRSTSTAYMELRSLRAEDTAVYYCNAAYG<br>VSSYPMDYWGQGTLVTVSS |
| 99 | CG_113_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 100 | CG_113_VH | QMQLVQSGAEVKKPGSSVKVSCKASGFNIKDYYLHWVRQAPGKGLEWMG<br>WILPDQGDTEYAQKFQGRVTITRDRSTSTAYMELRSLRAEDTAVYYCNAAYGY<br>SSYPMDYWGQGTLVTVSS |
| 101 | CG_114_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 102 | CG_114_VH | QMQLVQSGAEVKKPGSSVKVSCKASGFNIKDYYLHWVRQAPGKGLEWMG<br>WIDPDQGATYYAQKFQGRVTITRDRSTSTAYMELRSLRAEDTAVYYCNAAYGS<br>SSYPMDYWGQGTLVTVSS |
| 103 | CG_115_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 104 | CG_115_VH | QMQLVQSGAEVKKPGSSVKVSCKASGFNIKDYYLHWVRQAPGKGLEWMG<br>WIDPDTGDTEYAQKFQGRVTITRDRSTSTAYMELRSLRAEDTAVYYCNAAYYS<br>SSYPMDYWGQGTLVTVSS |
| 105 | CG_116_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 106 | CG_116_VH | QMQLVQSGAEVKKPGSSVKVSCKASGFNIKDYYLHWVRQAPGKGLEWMG<br>WIDPDQGDTSYAQKFQGRVTITRDRSTSTAYMELRSLRAEDTAVYYCNAAYG<br>YSSYPMDYWGQGTLVTVSS |
| 107 | CG_117_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 108 | CG_117_VH | QMQLVQSGAEVKKPGSSVKVSCKASGFNIKDYYLHWVRQAPGKGLEWMG<br>WIDPDQGDTAYAQKFQGRVTITRDRSTSTAYMELRSLRAEDTAVYYCNAAYG<br>LSSYPMDYWGQGTLVTVSS |
| 109 | CG_118_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 110 | CG_118_VH | QMQLVQSGAEVKKPGSSVKVSCKASGFNIKDYYLHWVRQAPGKGLEWMG<br>WIDPDVGSTEYAQKFQGRVTITRDRSTSTAYMELRSLRAEDTAVYYCNAAYGS<br>SSYPMDYWGQGTLVTVSS |
| 111 | CG_119_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 112 | CG_119_VH | QMQLVQSGAEVKKPGSSVKVSCKASGFNIKDYYLHWVRQAPGKGLEWMG<br>WIDPDQGATSYAQKFQGRVTITRDRSTSTAYMELRSLRAEDTAVYYCNAAYGS<br>SSYPMDYWGQGTLVTVSS |
| 113 | CG_120_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 114 | CG_120_VH | QMQLVQSGAEVKKPGSSVKVSCKASGFNIKDYYLHWVRQAPGKGLEWMG<br>WILPDSGDTEYAQKFQGRVTITRDRSTSTAYMELRSLRAEDTAVYYCNAAYGS<br>SSYPMDYWGQGTLVTVSS |
| 115 | CG_121_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 116 | CG_121_VH | QMQLVQSGAEVKKPGSSVKVSCKASGFNIKDYYLHWVRQAPGKGLEWMG<br>WIDPDLGDTSYAQKFQGRVTITRDRSTSTAYMELRSLRAEDTAVYYCNAAYGS<br>SSYPMDYWGQGTLVTVSS |
| 117 | CG_122_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 118 | CG_122_VH | QMQLVQSGAEVKKPGSSVKVSCKASGFNIKDYYLHWVRQAPGKGLEWMG<br>WIDPDQGLTEYAQKFQGRVTITRDRSTSTAYMELRSLRAEDTAVYYCNAAYDS<br>SSYPMDYWGQGTLVTVSS |

TABLE 2-continued

Sequence Listing

| SEQ ID NO: | Description | Amino Acid Sequence |
|---|---|---|
| 119 | CG_123_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 120 | CG_123_VH | QMQLVQSGAEVKKPGSSVKVSCKASGFNIKDYYLHWVRQAPGKGLEWMG<br>WIDPDVGDTEYAQKFQGRVTITRDRSTSTAYMELRSLRAEDTAVYYCNAAYG<br>VSSYPMDYWGQGTLVTVSS |
| 121 | CG_124_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 122 | CG_124_VH | QMQLVQSGAEVKKPGSSVKVSCKASGFNIKDYYLHWVRQAPGKGLEWMG<br>WIDPDQGTTYYAQKFQGRVTITRDRSTSTAYMELRSLRAEDTAVYYCNAAYGS<br>SSYPMDYWGQGTLVTVSS |
| 123 | CG_125_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 124 | CG_125_VH | QMQLVQSGAEVKKPGSSVKVSCKASGFNIKDYYLHWVRQAPGKGLEWMG<br>WIDPDQGDTLYAQKFQGRVTITRDRSTSTAYMELRSLRAEDTAVYYCNAAYG<br>DSSYPMDYWGQGTLVTVSS |
| 125 | CG_126_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 126 | CG_126_VH | QMQLVQSGAEVKKPGSSVKVSCKASGFNIKDYYLHWVRQAPGKGLEWMG<br>WIDPDLGDTYYAQKFQGRVTITRDRSTSTAYMELRSLRAEDTAVYYCNAAYGS<br>SSYPMDYWGQGTLVTVSS |
| 127 | CG_127_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 128 | CG_127_VH | QMQLVQSGAEVKKPGSSVKVSCKASGFNIKVYYLHWVRQAPGKGLEWMG<br>WIDPDQGDTEYAQKFQGRVTITRDRSTSTAYMELRSLRAEDTAVYYCNAAYG<br>YSSYPMDYWGQGTLVTVSS |
| 129 | CG_128_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 130 | CG_128_VH | QMQLVQSGAEVKKPGSSVKVSCKASGFNIKDYYLHWVRQAPGKGLEWMG<br>WIDPDQGHTEYAQKFQGRVTITRDRSTSTAYMELRSLRAEDTAVYYCNAAYYS<br>SSYPMDYWGQGTLVTVSS |
| 131 | CG_129_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 132 | CG_129_VH | QMQLVQSGAEVKKPGSSVKVSCKASGFNIKDYYLHWVRQAPGKGLEWMG<br>WIDPDQGDTYYAQKFQGRVTITRDRSTSTAYMELRSLRAEDTAVYYCNAAYG<br>YSSYPMDYWGQGTLVTVSS |
| 133 | CG_130_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 134 | CG_130_VH | QMQLVQSGAEVKKPGSSVKVSCKASGFNIKDYYLHWVRQAPGKGLEWMG<br>WIDPLVGDTEYAQKFQGRVTITRDRSTSTAYMELRSLRAEDTAVYYCNAAYGS<br>SSYPMDYWGQGTLVTVSS |
| 135 | CG_131_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 136 | CG_131_VH | QMQLVQSGAEVKKPGSSVKVSCKASGFNIKDYVLHWVRQAPGKGLEWMG<br>WIDPDLGDTEYAQKFQGRVTITRDRSTSTAYMELRSLRAEDTAVYYCNAAYGS<br>SSYPMDYWGQGTLVTVSS |
| 137 | CG_132_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 138 | CG_132_VH | QMQLVQSGAEVKKPGSSVKVSCKASGFNIKDYYLHWVRQAPGKGLEWMG<br>WIDPDEGLTEYAQKFQGRVTITRDRSTSTAYMELRSLRAEDTAVYYCNAAYGS<br>SSYPMDYWGQGTLVTVSS |
| 139 | CG_133_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |

TABLE 2-continued

Sequence Listing

| SEQ ID NO: | Description | Amino Acid Sequence |
|---|---|---|
| 140 | CG_133_VH | QMQLVQSGAEVKKPGSSVKVSCKASGFNIKDYYLHWVRQAPGKGLEWMG<br>WIDPDQGDTYYAQKFQGRVTITRDRSTSTAYMELRSLRAEDTAVYYCNAAYG<br>KSSYPMDYWGQGTLVTVSS |
| 141 | CG_134_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 142 | CG_134_VH | QMQLVQSGAEVKKPGSSVKVSCKASGFNIKDYYLHWVRQAPGKGLEWMG<br>WILPDQGDSEYAQKFQGRVTITRDRSTSTAYMELRSLRAEDTAVYYCNAAYGS<br>SSYPMDYWGQGTLVTVSS |
| 143 | CG_135_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 144 | CG_135_VH | QMQLVQSGAEVKKPGSSVKVSCKASGFNIKDYYLHWVRQAPGKGLEWMG<br>WIQPDQGDTAYAQKFQGRVTITRDRSTSTAYMELRSLRAEDTAVYYCNAAYG<br>SSSYPMDYWGQGTLVTVSS |
| 145 | CG_136_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 146 | CG_136_VH | QMQLVQSGAEVKKPGSSVKVSCKASGFNIKDYYLHWVRQAPGKGLEWMG<br>WILPDVGDTEYAQKFQGRVTITRDRSTSTAYMELRSLRAEDTAVYYCNAAYGS<br>SSYPMDYWGQGTLVTVSS |
| 147 | CG_137_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 148 | CG_137_VH | QMQLVQSGAEVKKPGSSVKVSCKASGFNIKEYYLHWVRQAPGKGLEWMGW<br>IDPDTGDTEYAQKFQGRVTITRDRSTSTAYMELRSLRAEDTAVYYCNAAYGSSS<br>YPMDYWGQGTLVTVSS |
| 149 | CG_138_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 150 | CG_138_VH | QMQLVQSGAEVKKPGSSVKVSCKASGFNIKDYYLHWVRQAPGKGLEWMG<br>WILPDGGDTEYAQKFQGRVTITRDRSTSTAYMELRSLRAEDTAVYYCNAAYGS<br>SSYPMDYWGQGTLVTVSS |
| 151 | CG_139_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 152 | CG_139_VH | QMQLVQSGAEVKKPGSSVKVSCKASGFNIKDYYLHWVRQAPGKGLEWMG<br>WIDPDQGDTYYAQKFQGRVTITRDRSTSTAYMELRSLRAEDTAVYYCNAAYG<br>ESSYPMDYWGQGTLVTVSS |
| 153 | CG_140_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 154 | CG_140_VH | QMQLVQSGAEVKKPGSSVKVSCKASGFNIKDYYLHWVRQAPGKGLEWMG<br>WIDPDQGDTYYAQKFQGRVTITRDRSTSTAYMELRSLRAEDTAVYYCNAAYG<br>VSSYPMDYWGQGTLVTVSS |
| 155 | CG_141_VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 156 | CG_141_VH | QMQLVQSGAEVKKPGSSVKVSCKASGFNIKDYYLHWVRQAPGKGLEWMG<br>WIDPDQGDTEYAQKFQGRVTITRDRSTSTAYMELRSLRAEDTAVYYCNAAYYY<br>SSYPMDYWGQGTLVTVSS |
| 157 | CG_142_VL | NIQMTQSPSSLSASVGDRVTITCRASQDIHRYLSWFQQKPGKVPKHLIYRANYL<br>VSGVPSRFSGSGSGTEFTLTISSLQPEDFATYYCLQYDQFPYTFGGGTKVEIK |
| 158 | CG_142_VH | QMQLVQSGAEVKKPGSSVKVSCKASGFNIKDYYLHWVRQAPGKGLEWMG<br>WIDPDQGDTEYAQKFQGRVTITRDRSTSTAYMELRSLRAEDTAVYYCNAAYG<br>SSSYPMDYWGQGTLVTVSS |
| 159 | CG_143_VL | NIQMTQSPSSLSASVGDRVTITCRASQDIQRYLSWFQQKPGKVPKHLIYYANR<br>LVSGVPSRFSGSGSGTEFTLTISSLQPEDFATYYCLQYDEFPYTFGGGTKVEIK |
| 160 | CG_143_VH | QMQLVQSGAEVKKPGSSVKVSCKASGFNIKDYYLHWVRQAPGKGLEWMG<br>WIDPDQGDTEYAQKFQGRVTITRDRSTSTAYMELRSLRAEDTAVYYCNAAYG<br>SSSYPMDYWGQGTLVTVSS |

TABLE 2-continued

Sequence Listing

| SEQ ID NO: | Description | Amino Acid Sequence |
|---|---|---|
| 161 | CG_144_VL | NIQMTQSPSSLSASVGDRVTITCRASQDISRYLSWFQQKPGKVPKHLIYYANRL VSGVPSRFSGSGSGTEFTLTISSLQPEDFATYYCLQYDEFPYTFGGGTKVEIK |
| 162 | CG_144_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 163 | CG_145_VL | NIQMTQSPSSLSASVGDRVTITCRASQDIHRYLSWFQQKPGKVPKHLIYRANYL VSGVPSRFSGSGSGTEFTLTISSLQPEDFATYYCLQYDHFPYTFGGGTKVEIK |
| 164 | CG_145_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 165 | CG_146_VL | NIQMTQSPSSLSASVGDRVTITCRASQDIHRYLSWFQQKPGKVPKHLIYYANRL VSGVPSRFSGSGSGTEFTLTISSLQPEDFATYYCLQYYEFPYTFGGGTKVEIK |
| 166 | CG_146_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 167 | CG_147_VL | NIQMTQSPSSLSASVGDRVTITCRASQDIARYLSWFQQKPGKVPKHLIYRANRL VSGVPSRFSGSGSGTEFTLTISSLQPEDFATYYCLQYDVFPYTFGGGTKVEIK |
| 168 | CG_147_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 169 | CG_148_VL | NIQMTQSPSSLSASVGDRVTITCRASQDIHRYLSWFQQKPGKVPKHLIYRANYL VSGVPSRFSGSGSGTEFTLTISSLQPEDFATYYCLQYDLFPYTFGGGTKVEIK |
| 170 | CG_148_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 171 | CG_149_VL | NIQMTQSPSSLSASVGDRVTITCRASQDIHRYLSWFQQKPGKVPKHLIYRANYL VSGVPSRFSGSGSGTEFTLTISSLQPEDFATYYCLQYQEFPYTFGGGTKVEIK |
| 172 | CG_149_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 173 | CG_150_VL | NIQMTQSPSSLSASVGDRVTITCRASQDIYYYLSWFQQKPGKVPKHLIYRANRL VSGVPSRFSGSGSGTEFTLTISSLQPEDFATYYCLQYDEFPYTFGGGTKVEIK |
| 174 | CG_150_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 175 | CG_151_VL | NIQMTQSPSSLSASVGDRVTITCRASQDIHRYLSWFQQKPGKVPKHLIYRANYL VSGVPSRFSGSGSGTEFTLTISSLQPEDFATYYCLQYVEFPYTFGGGTKVEIK |
| 176 | CG_151_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 177 | CG_152_VL | NIQMTQSPSSLSASVGDRVTITCRASQDIHRYLSWFQQKPGKVPKHLIYYANRL VSGVPSRFSGSGSGTEFTLTISSLQPEDFATYYCLQYHEFPYTFGGGTKVEIK |
| 178 | CG_152_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 179 | CG_153_VL | NIQMTQSPSSLSASVGDRVTITCRASQDIERYLSWFQQKPGKVPKHLIYYANRL VSGVPSRFSGSGSGTEFTLTISSLQPEDFATYYCLQYDEFPYTFGGGTKVEIK |
| 180 | CG_153_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 181 | CG_154_VL | NIQMTQSPSSLSASVGDRVTITCRASQDIHRYLSWFQQKPGKVPKHLIYRANYL VSGVPSRFSGSGSGTEFTLTISSLQPEDFATYYCLQYDKFPYTFGGGTKVEIK |

TABLE 2-continued

Sequence Listing

| SEQ ID NO: | Description | Amino Acid Sequence |
|---|---|---|
| 182 | CG_154_VH | QMQLVQSGAEVKKPGSSVKVSCKASGFNIKDYYLHWVRQAPGKGLEWMGWIDPDQGDTEYAQKFQGRVTITRDRSTSTAYMELRSLRAEDTAVYYCNAAYGSSSYPMDYWGQGTLVTVSS |
| 183 | CG_155_VL | NIQMTQSPSSLSASVGDRVTITCRASQDIYTYLSWFQQKPGKVPKHLIYRANRLVSGVPSRFSGSGSGTEFTLTISSLQPEDFATYYCLQYDEFPYTFGGGTKVEIK |
| 184 | CG_155_VH | QMQLVQSGAEVKKPGSSVKVSCKASGFNIKDYYLHWVRQAPGKGLEWMGWIDPDQGDTEYAQKFQGRVTITRDRSTSTAYMELRSLRAEDTAVYYCNAAYGSSSYPMDYWGQGTLVTVSS |
| 185 | CG_156_VL | NIQMTQSPSSLSASVGDRVTITCRASQDILRYLSWFQQKPGKVPKHLIYYANRLVSGVPSRFSGSGSGTEFTLTISSLQPEDFATYYCLQYDEFPYTFGGGTKVEIK |
| 186 | CG_156_VH | QMQLVQSGAEVKKPGSSVKVSCKASGFNIKDYYLHWVRQAPGKGLEWMGWIDPDQGDTEYAQKFQGRVTITRDRSTSTAYMELRSLRAEDTAVYYCNAAYGSSSYPMDYWGQGTLVTVSS |
| 187 | CG_157_VL | NIQMTQSPSSLSASVGDRVTITCRASQDITRYLSWFQQKPGKVPKHLIYYANRLVSGVPSRFSGSGSGTEFTLTISSLQPEDFATYYCLQYDEFPYTFGGGTKVEIK |
| 188 | CG_157_VH | QMQLVQSGAEVKKPGSSVKVSCKASGFNIKDYYLHWVRQAPGKGLEWMGWIDPDQGDTEYAQKFQGRVTITRDRSTSTAYMELRSLRAEDTAVYYCNAAYGSSSYPMDYWGQGTLVTVSS |
| 189 | CG_158_VL | NIQMTQSPSSLSASVGDRVTITCRASQDIDRYLSWFQQKPGKVPKHLIYRANRLVSGVPSRFSGSGSGTEFTLTISSLQPEDFATYYCLQYDLFPYTFGGGTKVEIK |
| 190 | CG_158_VH | QMQLVQSGAEVKKPGSSVKVSCKASGFNIKDYYLHWVRQAPGKGLEWMGWIDPDQGDTEYAQKFQGRVTITRDRSTSTAYMELRSLRAEDTAVYYCNAAYGSSSYPMDYWGQGTLVTVSS |
| 191 | CG_159_VL | NIQMTQSPSSLSASVGDRVTITCRASQDIHVYLSWFQQKPGKVPKHLIYRANRLVSGVPSRFSGSGSGTEFTLTISSLQPEDFATYYCLQYYEFPYTFGGGTKVEIK |
| 192 | CG_159_VH | QMQLVQSGAEVKKPGSSVKVSCKASGFNIKDYYLHWVRQAPGKGLEWMGWIDPDQGDTEYAQKFQGRVTITRDRSTSTAYMELRSLRAEDTAVYYCNAAYGSSSYPMDYWGQGTLVTVSS |
| 193 | CG_160_VL | NIQMTQSPSSLSASVGDRVTITCRASQDIHRYLSWFQQKPGKVPKHLIYRANYLVSGVPSRFSGSGSGTEFTLTISSLQPEDFATYYCLQYAEFPYTFGGGTKVEIK |
| 194 | CG_160_VH | QMQLVQSGAEVKKPGSSVKVSCKASGFNIKDYYLHWVRQAPGKGLEWMGWIDPDQGDTEYAQKFQGRVTITRDRSTSTAYMELRSLRAEDTAVYYCNAAYGSSSYPMDYWGQGTLVTVSS |
| 195 | CG_161_VL | NIQMTQSPSSLSASVGDRVTITCRASQDILTYLSWFQQKPGKVPKHLIYRANRLVSGVPSRFSGSGSGTEFTLTISSLQPEDFATYYCLQYDEFPYTFGGGTKVEIK |
| 196 | CG_161_VH | QMQLVQSGAEVKKPGSSVKVSCKASGFNIKDYYLHWVRQAPGKGLEWMGWIDPDQGDTEYAQKFQGRVTITRDRSTSTAYMELRSLRAEDTAVYYCNAAYGSSSYPMDYWGQGTLVTVSS |
| 197 | CG_162_VL | NIQMTQSPSSLSASVGDRVTITCRASQDIARYLSWFQQKPGKVPKHLIYYANRLVSGVPSRFSGSGSGTEFTLTISSLQPEDFATYYCLQYDEFPYTFGGGTKVEIK |
| 198 | CG_162_VH | QMQLVQSGAEVKKPGSSVKVSCKASGFNIKDYYLHWVRQAPGKGLEWMGWIDPDQGDTEYAQKFQGRVTITRDRSTSTAYMELRSLRAEDTAVYYCNAAYGSSSYPMDYWGQGTLVTVSS |
| 199 | CG_163_VL | NIQMTQSPSSLSASVGDRVTITCRASQDIVTYLSWFQQKPGKVPKHLIYRANRLVSGVPSRFSGSGSGTEFTLTISSLQPEDFATYYCLQYDEFPYTFGGGTKVEIK |
| 200 | CG_163_VH | QMQLVQSGAEVKKPGSSVKVSCKASGFNIKDYYLHWVRQAPGKGLEWMGWIDPDQGDTEYAQKFQGRVTITRDRSTSTAYMELRSLRAEDTAVYYCNAAYGSSSYPMDYWGQGTLVTVSS |
| 201 | CG_164_VL | NIQMTQSPSSLSASVGDRVTITCRASQDILEYLSWFQQKPGKVPKHLIYRANRLVSGVPSRFSGSGSGTEFTLTISSLQPEDFATYYCLQYDEFPYTFGGGTKVEIK |
| 202 | CG_164_VH | QMQLVQSGAEVKKPGSSVKVSCKASGFNIKDYYLHWVRQAPGKGLEWMGWIDPDQGDTEYAQKFQGRVTITRDRSTSTAYMELRSLRAEDTAVYYCNAAYGSSSYPMDYWGQGTLVTVSS |

TABLE 2-continued

Sequence Listing

| SEQ ID NO: | Description | Amino Acid Sequence |
|---|---|---|
| 203 | CG_165_VL | NIQMTQSPSSLSASVGDRVTITCRASQDIHRYLSWFQQKPGKVPKHLIYRANYL VSGVPSRFSGSGSGTEFTLTISSLQPEDFATYYCLQYYEFPYTFGGGTKVEIK |
| 204 | CG_165_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 205 | CG_166_VL | NIQMTQSPSSLSASVGDRVTITCRASQDIHRYLSWFQQKPGKVPKHLIYYANRL VSGVPSRFSGSGSGTEFTLTISSLQPEDFATYYCLQYDVFPYTFGGGTKVEIK |
| 206 | CG_166_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 207 | CG_167_VL | NIQMTQSPSSLSASVGDRVTITCRASQDILVYLSWFQQKPGKVPKHLIYRANRL VSGVPSRFSGSGSGTEFTLTISSLQPEDFATYYCLQYDEFPYTFGGGTKVEIK |
| 208 | CG_167_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 209 | CG_168_VL | NIQMTQSPSSLSASVGDRVTITCRASQDIHRYLSWFQQKPGKVPKHLIYRANR LVSGVPSRFSGSGSGTEFTLTISSLQPEDFATYYCLQYAEFPYTFGGGTKVEIK |
| 210 | CG_168_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 211 | CG_169_VL | NIQMTQSPSSLSASVGDRVTITCRASQDIHRYLSWFQQKPGKVPKHLIYRANR LVSGVPSRFSGSGSGTEFTLTISSLQPEDFATYYCLQYQEFPYTFGGGTKVEIK |
| 212 | CG_169_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 213 | CG_170_VL | NIQMTQSPSSLSASVGDRVTITCRASQDIHRYLSWFQQKPGKVPKHLIYRANR LVSGVPSRFSGSGSGTEFTLTISSLQPEDFATYYCLQYEEFPYTFGGGTKVEIK |
| 214 | CG_170_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 215 | CG_171_VL | NIQMTQSPSSLSASVGDRVTITCRASQDIH DYLSWFQQKPGKVPKHLIYRANIL VSGVPSRFSGSGSGTEFTLTISSLQPEDFATYYCLQYDEFPYTFGGGTKVEIK |
| 216 | CG_171_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 217 | CG_172_VL | NIQMTQSPSSLSASVGDRVTITCRASQDIHDYLSWFQQKPGKVPKHLIYRANLL VSGVPSRFSGSGSGTEFTLTISSLQPEDFATYYCLQYDEFPYTFGGGTKVEIK |
| 218 | CG_172_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 219 | CG_173_VL | NIQMTQSPSSLSASVGDRVTITCRASQDIHDYLSWFQQKPGKVPKHLIYRANY LVSGVPSRFSGSGSGTEFTLTISSLQPEDFATYYCLQYDEFPYTFGGGTKVEIK |
| 220 | CG_173_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 221 | CG_174_VL | NIQMTQSPSSLSASVGDRVTITCRASQDIHEYLSWFQQKPGKVPKHLIYRANA LVSGVPSRFSGSGSGTEFTLTISSLQPEDFATYYCLQYDEFPYTFGGGTKVEIK |
| 222 | CG_174_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 223 | CG_175_VL | NIQMTQSPSSLSASVGDRVTITCRASQDIHEYLSWFQQKPGKVPKHLIYRANIL VSGVPSRFSGSGSGTEFTLTISSLQPEDFATYYCLQYDEFPYTFGGGTKVEIK |

TABLE 2-continued

Sequence Listing

| SEQ ID NO: | Description | Amino Acid Sequence |
|---|---|---|
| 224 | CG_175_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 225 | CG_176_VL | NIQMTQSPSSLSASVGDRVTITCRASQDIHEYLSWFQQKPGKVPKHLIYRANLL VSGVPSRFSGSGSGTEFTLTISSLQPEDFATYYCLQYDEFPYTFGGGTKVEIK |
| 226 | CG_176_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 227 | CG_177_VL | NIQMTQSPSSLSASVGDRVTITCRASQDIHEYLSWFQQKPGKVPKHLIYRANQ LVSGVPSRFSGSGSGTEFTLTISSLQPEDFATYYCLQYDEFPYTFGGGTKVEIK |
| 228 | CG_177_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 229 | CG_178_VL | NIQMTQSPSSLSASVGDRVTITCRASQDIHEYLSWFQQKPGKVPKHLIYRANVL VSGVPSRFSGSGSGTEFTLTISSLQPEDFATYYCLQYDEFPYTFGGGTKVEIK |
| 230 | CG_178_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 231 | CG_179_VL | NIQMTQSPSSLSASVGDRVTITCRASQDIHIYLSWFQQKPGKVPKHLIYRANDL VSGVPSRFSGSGSGTEFTLTISSLQPEDFATYYCLQYDEFPYTFGGGTKVEIK |
| 232 | CG_179_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 233 | CG_180_VL | NIQMTQSPSSLSASVGDRVTITCRASQDIHIYLSWFQQKPGKVPKHLIYRANTL VSGVPSRFSGSGSGTEFTLTISSLQPEDFATYYCLQYDEFPYTFGGGTKVEIK |
| 234 | CG_180_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 235 | CG_181_VL | NIQMTQSPSSLSASVGDRVTITCRASQDIHLYLSWFQQKPGKVPKHLIYRANDL VSGVPSRFSGSGSGTEFTLTISSLQPEDFATYYCLQYDEFPYTFGGGTKVEIK |
| 236 | CG_181_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 237 | CG_182_VL | NIQMTQSPSSLSASVGDRVTITCRASQDIHLYLSWFQQKPGKVPKHLIYRANEL VSGVPSRFSGSGSGTEFTLTISSLQPEDFATYYCLQYDEFPYTFGGGTKVEIK |
| 238 | CG_182_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 239 | CG_183_VL | NIQMTQSPSSLSASVGDRVTITCRASQDIHNYLSWFQQKPGKVPKHLIYRANE LVSGVPSRFSGSGSGTEFTLTISSLQPEDFATYYCLQYDEFPYTFGGGTKVEIK |
| 240 | CG_183_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 241 | CG_184_VL | NIQMTQSPSSLSASVGDRVTITCRASQDIHNYLSWFQQKPGKVPKHLIYRANV LVSGVPSRFSGSGSGTEFTLTISSLQPEDFATYYCLQYDEFPYTFGGGTKVEIK |
| 242 | CG_184_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 243 | CG_185_VL | NIQMTQSPSSLSASVGDRVTITCRASQDIHQYLSWFQQKPGKVPKHLIYRAND LVSGVPSRFSGSGSGTEFTLTISSLQPEDFATYYCLQYDEFPYTFGGGTKVEIK |
| 244 | CG_185_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |

TABLE 2-continued

Sequence Listing

| SEQ ID NO: | Description | Amino Acid Sequence |
|---|---|---|
| 245 | CG_186_VL | NIQMTQSPSSLSASVGDRVTITCRASQDIHVYLSWFQQKPGKVPKHLIYRANQ<br>LVSGVPSRFSGSGSGTEFTLTISSLQPEDFATYYCLQYDEFPYTFGGGTKVEIK |
| 246 | CG_186_VH | QMQLVQSGAEVKKPGSSVKVSCKASGFNIKDYYLHWVRQAPGKGLEWMG<br>WIDPDQGDTEYAQKFQGRVTITRDRSTSTAYMELRSLRAEDTAVYYCNAAYG<br>SSSYPMDYWGQGTLVTVSS |
| 247 | CG_187_VL | NIQMTQSPSSLSASVGDRVTITCRASQDIHTYLSWFQQKPGKVPKHLIYRANYL<br>VSGVPSRFSGSGSGTEFTLTISSLQPEDFATYYCLQYDEFPYTFGGGTKVEIK |
| 248 | CG_187_VH | QMQLVQSGAEVKKPGSSVKVSCKASGFNIKDYYLHWVRQAPGKGLEWMG<br>WIDPDQGDTEYAQKFQGRVTITRDRSTSTAYMELRSLRAEDTAVYYCNAAYG<br>SSSYPMDYWGQGTLVTVSS |
| 249 | CG_188_VL | NIQMTQSPSSLSASVGDRVTITCRASQDIHEYLSWFQQKPGKVPKHLIYRANYL<br>VSGVPSRFSGSGSGTEFTLTISSLQPEDFATYYCLQYDEFPYTFGGGTKVEIK |
| 250 | CG_188_VH | QMQLVQSGAEVKKPGSSVKVSCKASGFNIKDYYLHWVRQAPGKGLEWMG<br>WIDPDQGDTEYAQKFQGRVTITRDRSTSTAYMELRSLRAEDTAVYYCNAAYG<br>SSSYPMDYWGQGTLVTVSS |
| 251 | CG_189_VL | NIQMTQSPSSLSASVGDRVTITCRASQDIHLYLSWFQQKPGKVPKHLIYRANQ<br>LVSGVPSRFSGSGSGTEFTLTISSLQPEDFATYYCLQYDEFPYTFGGGTKVEIK |
| 252 | CG_189_VH | QMQLVQSGAEVKKPGSSVKVSCKASGFNIKDYYLHWVRQAPGKGLEWMG<br>WIDPDQGDTEYAQKFQGRVTITRDRSTSTAYMELRSLRAEDTAVYYCNAAYG<br>SSSYPMDYWGQGTLVTVSS |
| 253 | CG_190_VL | NIQMTQSPSSLSASVGDRVTITCRASQDIHVYLSWFQQKPGKVPKHLIYRANEL<br>VSGVPSRFSGSGSGTEFTLTISSLQPEDFATYYCLQYDEFPYTFGGGTKVEIK |
| 254 | CG_190_VH | QMQLVQSGAEVKKPGSSVKVSCKASGFNIKDYYLHWVRQAPGKGLEWMG<br>WIDPDQGDTEYAQKFQGRVTITRDRSTSTAYMELRSLRAEDTAVYYCNAAYG<br>SSSYPMDYWGQGTLVTVSS |
| 255 | CG_191_VL | NIQMTQSPSSLSASVGDRVTITCRASQDIHHYLSWFQQKPGKVPKHLIYRANY<br>LVSGVPSRFSGSGSGTEFTLTISSLQPEDFATYYCLQYDEFPYTFGGGTKVEIK |
| 256 | CG_191_VH | QMQLVQSGAEVKKPGSSVKVSCKASGFNIKDYYLHWVRQAPGKGLEWMG<br>WIDPDQGDTEYAQKFQGRVTITRDRSTSTAYMELRSLRAEDTAVYYCNAAYG<br>SSSYPMDYWGQGTLVTVSS |
| 257 | CG_192_VL | NIQMTQSPSSLSASVGDRVTITCRASQDIHIYLSWFQQKPGKVPKHLIYRANEL<br>VSGVPSRFSGSGSGTEFTLTISSLQPEDFATYYCLQYDEFPYTFGGGTKVEIK |
| 258 | CG_192_VH | QMQLVQSGAEVKKPGSSVKVSCKASGFNIKDYYLHWVRQAPGKGLEWMG<br>WIDPDQGDTEYAQKFQGRVTITRDRSTSTAYMELRSLRAEDTAVYYCNAAYG<br>SSSYPMDYWGQGTLVTVSS |
| 259 | CG_193_VL | NIQMTQSPSSLSASVGDRVTITCRASQDIHYYLSWFQQKPGKVPKHLIYRANEL<br>VSGVPSRFSGSGSGTEFTLTISSLQPEDFATYYCLQYDEFPYTFGGGTKVEIK |
| 260 | CG_193_VH | QMQLVQSGAEVKKPGSSVKVSCKASGFNIKDYYLHWVRQAPGKGLEWMG<br>WIDPDQGDTEYAQKFQGRVTITRDRSTSTAYMELRSLRAEDTAVYYCNAAYG<br>SSSYPMDYWGQGTLVTVSS |
| 261 | CG_194_VL | NIQMTQSPSSLSASVGDRVTITCRASQDIHHYLSWFQQKPGKVPKHLIYRAND<br>LVSGVPSRFSGSGSGTEFTLTISSLQPEDFATYYCLQYDEFPYTFGGGTKVEIK |
| 262 | CG_194_VH | QMQLVQSGAEVKKPGSSVKVSCKASGFNIKDYYLHWVRQAPGKGLEWMG<br>WIDPDQGDTEYAQKFQGRVTITRDRSTSTAYMELRSLRAEDTAVYYCNAAYG<br>SSSYPMDYWGQGTLVTVSS |
| 263 | CG_195_VL | NIQMTQSPSSLSASVGDRVTITCRASQDIHIYLSWFQQKPGKVPKHLIYRANDL<br>VSGVPSRFSGSGSGTEFTLTISSLQPEDFATYYCLQYDEFPYTFGGGTKVEIK |
| 264 | CG_195_VH | QMQLVQSGAEVKKPGSSVKVSCKASGFNIKDYYLHWVRQAPGKGLEWMG<br>WIDPDQGDTEYAQKFQGRVTITRDRSTSTAYMELRSLRAEDTAVYYCNAAYG<br>SSSYPMDYWGQGTLVTVSS |
| 265 | CG_196_VL | NIQMTQSPSSLSASVGDRVTITCRASQDIHYYLSWFQQKPGKVPKHLIYRAND<br>LVSGVPSRFSGSGSGTEFTLTISSLQPEDFATYYCLQYDEFPYTFGGGTKVEIK |

TABLE 2-continued

Sequence Listing

| SEQ ID NO: | Description | Amino Acid Sequence |
|---|---|---|
| 266 | CG_196_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 267 | CG_197_VL | NIQMTQSPSSLSASVGDRVTITCRASQDIHVYLSWFQQKPGKVPKHLIYRAND LVSGVPSRFSGSGSGTEFTLTISSLQPEDFATYYCLQYDEFPYTFGGGTKVEIK |
| 268 | CG_197_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 269 | CG_198_VL | NIQMTQSPSSLSASVGDRVTITCRASQDIHIYLSWFQQKPGKVPKHLIYRANQL VSGVPSRFSGSGSGTEFTLTISSLQPEDFATYYCLQYDEFPYTFGGGTKVEIK |
| 270 | CG_198_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 271 | CG_199_VL | NIQMTQSPSSLSASVGDRVTITCRASQDIHTYLSWFQQKPGKVPKHLIYRANQ LVSGVPSRFSGSGSGTEFTLTISSLQPEDFATYYCLQYDEFPYTFGGGTKVEIK |
| 272 | CG_199_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 273 | CG_200_VL | NIQMTQSPSSLSASVGDRVTITCRASQDIHRYLSWFQQKPGKVPKHLIYRANR LVSGVPSRFSGSGSGTEFTLTISSLQPEDFATYYCLQYDEFPYTFGGGTKVEIK |
| 274 | CG_200_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 275 | CG_201_VL | NIQMTQSPSSLSASVGDRVTITCRASQDIHRYLSWFQQKPGKVPKHLIYRESRF VDGVPSRFSGSGSGTEFTLTISSLQPEDFATYYCLQYDEFPYTFGGGTKVEIK |
| 276 | CG_201_VH | QMQLVQSGAEVKKPGSSVKVSCKASGFNIKDYYLHWVRQAPGKGLEWMG WIDPDQGDTYYAQKFQGRVTITRDRSTSTAYMELRSLRAEDTAVYYCNAAYG ESSYPMDYWGQGTLVTVSS |
| 277 | CG_202_VL | NIQMTQSPSSLSASVGDRVTITCQASQDIHRYLSWFQQDPGTVPQHLIYRESR FVDGVPSRFSGSGSGTEFTLTISSLQPEDFATYYCLQYDEFPYTFGGGTKVEIK |
| 278 | CG_202_VH | QMQLVQSGAEVKKPGSSVKVSCKASGFNIKDYYLHWVRQAPGQGLEWMG WIDPDQGDTYYAQKFQGRVTITRDRSTSTAYMELASLTAEDTAVYYCNAAYG ESSYPMDYWGQGTLVTVSS |
| 279 | CG_203_VL | NIQMTQSPSSLSASVGDRVTITCRASQDIHRYLSWFQQKPGKVPKHLIYRANR LVSGVPSRFSGSGSGTEFTLTISSLQPEDFATYYCLQYDEFPYTFGGGTKVEIK |
| 280 | CG_203_VH | QMQLVQSGAEVKKPGSSVKVSCKASGFNIKDYYLHWVRQAPGKGLEWMG WIDPDQGDTYYAQKFQGRVTITRDRSTSTAYMELRSLRAEDTAVYYCNAAYG ESSYPMDYWGQGTLVTVSS |
| 281 | CG_204_VL | NIQMTQSPSSLSASVGDRVTITCQASQDIHRYLSWFQQDPGTVPQHLIYRESR FVDGVPSRFSGSGSGTEFTLTISSLQPEDFATYYCLQYDEFPYTFGGGTKVEIK |
| 282 | CG_204_VH | QMQLVQSGAEVKKPGSSVKVSCKASGFNIKDYYLHWVRQAPGQGLEWMG WIDPDQGDTYYAQKFQGRVTITRDRSTSTAYMELASLTAEDTAVYYCNAAYG DSSYPMDYWGQGTLVTVSS |
| 283 | CG_205_VL | NIQMTQSPSSLSASVGDRVTITCRASQDIHRYLSWFQQKPGKVPKHLIYRESRF VDGVPSRFSGSGSGTEFTLTISSLQPEDFATYYCLQYDEFPYTFGGGTKVEIK |
| 284 | CG_205_VH | QMQLVQSGAEVKKPGSSVKVSCKASGFNIKDYYLHWVRQAPGKGLEWMG WIDPDQGDTYYAQKFQGRVTITRDRSTSTAYMELRSLRAEDTAVYYCNAAYG DSSYPMDYWGQGTLVTVSS |
| 285 | CG_206_VL | NIQMTQSPSSLSASVGDRVTITCQASQDIHRYLSWFQQDPGTVPQHLIYRESR FVDGVPSRFSGSGSGTEFTLTISSLQPEDFATYYCLQYDEFPYTFGGGTKVEIK |
| 286 | CG_206_VH | QMQLVQSGAEVKKPGSSVKVSCKASGFNIKDYYLHWVRQAPGQGLEWMGY IDPSQGDTVYAQKFQGRVTITRDRSTSTAYMELASLTAEDTAVYYCNAAYGSSS YPMDYWGQGTLVTVSS |

TABLE 2-continued

Sequence Listing

| SEQ ID NO: | Description | Amino Acid Sequence |
|---|---|---|
| 287 | CG_207_VL | NIQMTQSPSSLSASVGDRVTITCQASQDIHEYLSWFQQDPGTVPQHLIYRESLF VDGVPSRFSGSGSGTEFTLTISSLQPEDFATYYCLQYDEFPYTFGGGTKVEIK |
| 288 | CG_207_VH | QMQLVQSGAEVKKPGSSVKVSCKASGFNIKDYYLHWVRQAPGQGLEWMG WIDPDQGDTEYAQKFQGRVTITRDRSTSTAYMELASLTAEDTAVYYCNAAYG SSSYPMDYWGQGTLVTVSS |
| 289 | CG_208_VL | NIQMTQSPSSLSASVGDRVTITCQASQDIHRYLSWFQQDPGTVPQHLIYRESR FVDGVPSRFSGSGSGTEFTLTISSLQPEDFATYYCLQYDEFPYTFGGGTKVEIK |
| 290 | CG_208_VH | QMQLVQSGAEVKKPGSSVKVSCKASGFNIKDYYLHWVRQAPGQGLEWMG WIDPDQGDTAYAQKFQGRVTITRDRSTSTAYMELASLTAEDTAVYYCNAAYG LSSYPMDYWGQGTLVTVSS |
| 291 | CG_209_VL | NIQMTQSPSSLSASVGDRVTITCQASQDIHRYLSWFQQDPGTVPQHLIYRESR FVDGVPSRFSGSGSGTEFTLTISSLQPEDFATYYCLQYDEFPYTFGGGTKVEIK |
| 292 | CG_209_VH | QMQLVQSGAEVKKPGSSVKVSCKASGFNIKDYYLHWVRQAPGQGLEWMG WIDPDQGATYYAQKFQGRVTITRDRSTSTAYMELASLTAEDTAVYYCNAAYGS SSYPMDYWGQGTLVTVSS |
| 293 | CG_210_VL | NIQMTQSPSSLSASVGDRVTITCQASQDIHRYLSWFQQDPGTVPQHLIYRESR FVDGVPSRFSGSGSGTEFTLTISSLQPEDFATYYCLQYDEFPYTFGGGTKVEIK |
| 294 | CG_210_VH | QMQLVQSGAEVKKPGSSVKVSCKASGFNIKDYYLHWVRQAPGQGLEWMG WIDPDVGSTEYAQKFQGRVTITRDRSTSTAYMELASLTAEDTAVYYCNAAYGS SSYPMDYWGQGTLVTVSS |
| 295 | CG_211_VL | NIQMTQSPSSLSASVGDRVTITCQASQDIHRYLSWFQQDPGTVPQHLIYRESR FVDGVPSRFSGSGSGTEFTLTISSLQPEDFATYYCLQYDEFPYTFGGGTKVEIK |
| 296 | CG_211_VH | QMQLVQSGAEVKKPGSSVKVSCKASGFNIKDYYLHWVRQAPGQGLEWMG WIDPDQGDTEYAQKFQGRVTITRDRSTSTAYMELASLTAEDTAVYYCNAAYG SSSYPMDYWGQGTLVTVSS |
| 297 | CG_212_VL | NIQMTQSPSSLSASVGDRVTITCRASQDIHRYLSWFQQKPGKVPKHLIYRESRF VDGVPSRFSGSGSGTEFTLTISSLQPEDFATYYCLQYEEFPYTFGGGTKVEIK |
| 298 | CG_212_VH | QMQLVQSGAEVKKPGSSVKVSCKASGFNIKDYYLHWVRQAPGKGLEWMG WIDPDQGLTEYAQKFQGRVTITRDRSTSTAYMELRSLRAEDTAVYYCNAAYGS SSYPMDYWGQGTLVTVSS |
| 299 | CG_213_VL | NIQMTQSPSSLSASVGDRVTITCQASQDIHRYLSWFQQDPGTVPQHLIYRESR FVDGVPSRFSGSGSGTEFTLTISSLQPEDFATYYCLQYEEFPYTFGGGTKVEIK |
| 300 | CG_213_VH | QMQLVQSGAEVKKPGSSVKVSCKASGFNIKDYYLHWVRQAPGQGLEWMG WIDPDQGDTEYAQKFQGRVTITRDRSTSTAYMELASLTAEDTAVYYCNAAYG SSSYPMDYWGQGTLVTVSS |
| 301 | CG_214_VL | NIQMTQSPSSLSASVGDRVTITCRASQDIHRYLSWFQQKPGKVPKHLIYRESRF VDGVPSRFSGSGSGTEFTLTISSLQPEDFATYYCLQYAEFPYTFGGGTKVEIK |
| 302 | CG_214_VH | QMQLVQSGAEVKKPGSSVKVSCKASGFNIKDYYLHWVRQAPGKGLEWMG WIDPDQGLTEYAQKFQGRVTITRDRSTSTAYMELRSLRAEDTAVYYCNAAYGS SSYPMDYWGQGTLVTVSS |
| 303 | CG_215_VL | NIQMTQSPSSLSASVGDRVTITCQASQDIHRYLSWFQQDPGTVPQHLIYRESR FVDGVPSRFSGSGSGTEFTLTISSLQPEDFATYYCLQYAEFPYTFGGGTKVEIK |
| 304 | CG_215_VH | QMQLVQSGAEVKKPGSSVKVSCKASGFNIKDYYLHWVRQAPGQGLEWMG WIDPDQGDTEYAQKFQGRVTITRDRSTSTAYMELASLTAEDTAVYYCNAAYG SSSYPMDYWGQGTLVTVSS |
| 305 | CG_216_VL | NIQMTQSPSSLSASVGDRVTITCRASQDIHRYLSWFQQKPGKVPKHLIYRANR LVSGVPSRFSGSGSGTEFTLTISSLQPEDFATYYCLQYAEFPYTFGGGTKVEIK |
| 306 | CG_216_VH | QMQLVQSGAEVKKPGSSVKVSCKASGFNIKDYYLHWVRQAPGKGLEWMG WIDPDQGDTEYAQKFQGRVTITRDRSTSTAYMELRSLRAEDTAVYYCNAAYG SSSYPMDYWGQGTLVTVSS |
| 307 | CG_217_VL | NIQMTQSPSSLSASVGDRVTITCRASQDIHRYLSWFQQKPGKVPKHLIYRESRF VDGVPSRFSGSGSGTEFTLTISSLQPEDFATYYCLQYDEFPYTFGGGTKVEIK |

TABLE 2-continued

Sequence Listing

| SEQ ID NO: | Description | Amino Acid Sequence |
|---|---|---|
| 308 | CG_217_VH | QMQLVQSGAEVKKPGSSVKVSCKASGFNIKDYYLHWVRQAPGKGLEWMG<br>WIDPDEGLTEYAQKFQGRVTITRDRSTSTAYMELRSLRAEDTAVYYCNAAYGS<br>SSYPMDYWGQGTLVTVSS |
| 309 | CG_218_VL | NIQMTQSPSSLSASVGDRVTITCQASQDIHRYLSWFQQDPGTVPQHLIYRESR<br>FVDGVPSRFSGSGSGTEFTLTISSLQPEDFATYYCLQYDEFPYTFGGGTKVEIK |
| 310 | CG_218_VH | QMQLVQSGAEVKKPGSSVKVSCKASGFNIKDYYLHWVRQAPGQGLEWMG<br>WIDPDEGLTEYAQKFQGRVTITRDRSTSTAYMELASLTAEDTAVYYCNAAYGS<br>SSYPMDYWGQGTLVTVSS |
| 311 | CG_219_VL | NIQMTQSPSSLSASVGDRVTITCQASQDIHRYLSWFQQDPGTVPQHLIYRESR<br>FVDGVPSRFSGSGSGTEFTLTISSLQPEDFATYYCLQYDEFPYTFGGGTKVEIK |
| 312 | CG_219_VH | QMQLVQSGAEVKKPGSSVKVSCKASGFNIKDYYLHWVRQAPGQGLEWMG<br>WIDPDQGDTYYAQKFQGRVTITRDRSTSTAYMELASLTAEDTAVYYCNAAYG<br>DSSYPMDYWGQGTLVTVSS |
| 313 | CG_220_VL | NIQMTQSPSSLSASVGDRVTITCQASQDIHRYLSWFQQDPGTVPQHLIYRESR<br>FVDGVPSRFSGSGSGTEFTLTISSLQPEDFATYYCLQYDEFPYTFGGGTKVEIK |
| 314 | CG_220_VH | QMQLVQSGAEVKKPGSSVKVSCKASGFNIKDYYLHWVRQAPGQGLEWMG<br>WIDPDQGDTVYAQKFQGRVTITRDRSTSTAYMELASLTAEDTAVYYCNAAYG<br>ESSYPMDYWGQGTLVTVSS |
| 315 | CG_221_VL | NIQMTQSPSSLSASVGDRVTITCRASQDIHRYLSWFQQKPGKVPKHLIYRESRF<br>VDGVPSRFSGSGSGTEFTLTISSLQPEDFATYYCLQYDEFPYTFGGGTKVEIK |
| 316 | CG_221_VH | QMQLVQSGAEVKKPGSSVKVSCKASGFNIKDYYLHWVRQAPGKGLEWMG<br>WIDPDQGDTYYAQKFQGRVTITRDRSTSTAYMELRSLRAEDTAVYYCNAAYG<br>DSSYPMDYWGQGTLVTVSS |
| 317 | TPP-1361 CD47 VL | NIQMTQSPSSLSASVGDRVTITCQASQDIHRYLSWFQQDPGTVPQHLIYRESR<br>FVDGVPSRFSGSGSGTEFTLTISSLQPEDFATYYCLQYDEFPYTFGGGTKVEIK |
| 318 | TPP-1361 CD47 VH | QMQLVQSGAEVKKPGSSVKVSCKASGFNIKDYYLHWVRQAPGQGLEWMG<br>WIDPDQGDTYYAQKFQGRVTITRDRSTSTAYMELASLTAEDTAVYYCNAAYG<br>ESSYPMDYWGQGTLVTVSS |
| 319 | TPP-1360 CD47 VL | NIQMTQSPSSLSASVGDRVTITCRASQDIHRYLSWFQQKPGKVPKHLIYRESRF<br>VDGVPSRFSGSGSGTEFTLTISSLQPEDFATYYCLQYDEFPYTFGGGTKVEIK |
| 320 | TPP-1360 CD47 VH | QMQLVQSGAEVKKPGSSVKVSCKASGFNIKDYYLHWVRQAPGKGLEWMG<br>WIDPDQGDTYYAQKFQGRVTITRDRSTSTAYMELRSLRAEDTAVYYCNAAYG<br>ESSYPMDYWGQGTLVTVSS |
| 321 | TPP-1367 CD47 VL | NIQMTQSPSSLSASVGDRVTITCRASQDIHRYLSWFQQKPGKVPKHLIYRANR<br>LVSGVPSRFSGSGSGTEFTLTISSLQPEDFATYYCLQYDEFPYTFGGGTKVEIK |
| 322 | TPP-1367 CD47 VH | QMQLVQSGAEVKKPGSSVKVSCKASGFNIKDYYLHWVRQAPGKGLEWMG<br>WIDPDQGDTYYAQKFQGRVTITRDRSTSTAYMELRSLRAEDTAVYYCNAAYG<br>ESSYPMDYWGQGTLVTVSS |
| 323 | CD20 VL | QIVLSQSPAILSASPGEKVTMTCRASSSVSYIHWFQQKPGSSPKPWIYATSNLA<br>SGVPVRFSGSGSGTSYSLTISRVEAEDAATYYCQQWTSNPPTFGGGTKLEIK |
| 324 | CD20 VH | QVQLQQPGAELVKPGASVKMSCKASGYTFTSYNMHWVKQTPGRGLEWIGAI<br>YPGNGDTSYNQKFKGKATLTADKSSSTAYMQLSSLTSEDSAVYYCARSTYYGG<br>DWYFNVWGAGTTVTVSA |
| 325 | 90002 VL | NIQMTQSPSAMSASVGDRVTITCKASQDIHRYLSWFQQKPGKVPKHLIYRAN<br>RLVSGVPSRFSGSGSGTEFTLTISSLQPEDFATYYCLQYDEFPYTFGGGTKVEIK |
| 326 | 90002 VH | QMQLVQSGAEVKKTGSSVKVSCKASGFNIKDYYLHWVRQAPGQALEWMG<br>WIDPDQGDTEYAQKFQDRVTITRDRSMSTAYMELSSLRSEDTAMYYCNAAY<br>GSSSYPMDYWGQGTTVTVSS |
| 327 | 90002 WHOLE LC/IgG1 | NIQMTQSPSAMSASVGDRVTITCKASQDIHRYLSWFQQKPGKVPKHLIYRAN<br>RLVSGVPSRFSGSGSGTEFTLTISSLQPEDFATYYCLQYDEFPYTFGGGTKVEIKR<br>TVAAPSVFIFPPSDEQLKSGTASVVCLLNNFYPREAKVQWKVDNALQSGNSQE<br>SVTEQDSKDSTYSLSSTLTLSKADYEKHKVYACEVTHQGLSSPVTKSFNRGEC |
| 328 | 90002 WHOLE HC/IgG1 | QMQLVQSGAEVKKTGSSVKVSCKASGFNIKDYYLHWVRQAPGQALEWMG<br>WIDPDQGDTEYAQKFQDRVTITRDRSMSTAYMELSSLRSEDTAMYYCNAAY |

TABLE 2-continued

Sequence Listing

| SEQ ID NO: | Description | Amino Acid Sequence |
|---|---|---|
| | | GSSSYPMDYWGQGTTVTVSSASTKGPSVFPLAPSSKSTSGGTAALGCLVKDYF PEPVTVSWNSGALTSGVHTFPAVLQSSGLYSLSSVVTVPSSSLGTQTYICNVNH KPSNTKVDKKVEPKSCDKTHTCPPCPAPELLGGPSVFLFPPKPKDTLMISRTPEV TCVVVDVSHEDPEVKFNWYVDGVEVHNAKTKPREEQYNSTYRVVSVLTVLHQ DWLNGKEYKCKVSNKALPAPIEKTISKAKGQPREPQVYTLPPSREEMTKNQVS LTCLVKGFYPSDIAVEWESNGQPENNYKTTPPVLDSDGSFFLYSKLTVDKSRW QQGNVFSCSVMHEALHNHYTQKSLSLSPGK |
| 329 | LC - WHOLE RITUXIMAB | QIVLSQSPAILSASPGEKVTMTCRASSSVSYIHWFQQKPGSSPKPWIYATSNLA SGVPVRFSGSGSGTSYSLTISRVEAEDAATYYCQQWTSNPPTFGGGTKLEIKRT VAAPSVFIFPPSDEQLKSGTASVVCLLNNFYPREAKVQWKVDNALQSGNSQES VTEQDSKDSTYSLSSTLTLSKADYEKHKVYACEVTHQGLSSPVTKSFNRGEC |
| 330 | HC - WHOLE RITUXIMAB | QVQLQQPGAELVKPGASVKMSCKASGYTFTSYNMHWVKQTPGRGLEWIGAI YPGNGDTSYNQKFKGKATLTADKSSSTAYMQLSSLTSEDSAVYYCARSTYYGG DWYFNVWGAGTTVTVSSASTKGPSVFPLAPSSKSTSGGTAALGCLVKDYFPEP VTVSWNSGALTSGVHTFPAVLQSSGLYSLSSVVTVPSSSLGTQTYICNVNHKPS NTKVDKKVEPKSCDKTHTCPPCPAPELLGGPSVFLFPPKPKDTLMISRTPEVTC VVVDVSHEDPEVKFNWYVDGVEVHNAKTKPREEQYNSTYRVVSVLTVLHQD WLNGKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRWQQ GNVFSCSVMHEALHNHYTQKSLSLSPGK |
| 331 | CD20 WHOLE LC | QIVLSQSPAILSASPGEKVTMTCRASSSVSYIHWFQQKPGSSPKPWIYATSNLA SGVPVRFSGSGSGTSYSLTISRVEAEDAATYYCQQWTSNPPTFGGGTKLEIKRT VAAPSVAIFPPSDERLKSGTASVVCVLNNFYPREAKVQWKVDNALQSGNSQE SVTEQDSKDSTYSLSSRLTLSKADYEKHKVYACEVTHQGLSSPVTKSFNRGEC |
| 332 | CD20 WHOLE HC | QVQLQQPGAELVKPGASVKMSCKASGYTFTSYNMHWVKQTPGRGLEWIGAI YPGNGDTSYNQKFKGKATLTADKSSSTAYMQLSSLTSEDSAVYYCARSTYYGG DWYFNVWGAGTTVTVSSASTKGPSVFPLAPSSKSTSGGTAWLGCEVTDYFPE PVTVSWNSGALTSGVHTFPAVLESSGLYSLSSVVTVPSSSLGTQTYICNVNHKP SNTKVDKKVEPKSCDKTHTCPPCPAPELLGGPSVFLFPPKPKDTLMISRTPEVTC VVVDVSHEDPEVKFNWYVDGVEVHNAKTKPREEQYNSTYRVVSVLTVLHQD WLNGKEYKCKVSNKALPAPIEKTISKAKGQPREPQVYVPPSREEMTKNQVSL TCLVKGFYPSDIAVEWESNGQPENNYKTTPPVLDSDGSFALVSKLTVDKSRWQ QGNVFSCSVMHEALHNHYTQKSLSLSPGK |
| 333 | TPP-1361 CD47 WHOLE LC | NIQMTQSPSSLSASVGDRVTITCQASQDIHRYLSWFQQDPGTVPQHLIYRESR FVDGVPSRFSGSGSGTEFTLTISSLQPEDFATYYCLQYDEFPYTFGGGTKVEIKRT VAAPSVFIFPPSDEELKSGTASVVCWLNNFYPREAKVQWKVDNALQSGNSEE SVTEQDSKDSTYSLSSTLELSKADYEKHKVYACEVTHQGLSSPVTKSFNRGEC |
| 334 | TPP-1361 CD47 WHOLE HC | QMQLVQSGAEVKKPGSSVKVSCKASGFNIKDYYLHWVRQAPGQGLEWMG WIDPDQGDTYYAQKFQGRVTITRDRSTSTAYMELASLTAEDTAVYYCNAAYG ESSYPMDYWGQGTLVTVSSASTKGPSVFPLAPSSKSTSGGTAALGCLVKDYFP EPVTVSWNSGALTSGVHTFPAVLKSSGLYSLSSVVTVPSSSLGTQTYICNVNHK PSNTKVDKKVEPKSCDKTHTCPPCPAPELLGGPSVFLFPPKPKDTLMISRTPEVT CVVVDVSHEDPEVKFNWYVDGVEVHNAKTKPREEQYNSTYRVVSVLTVLHQ DWLNGKEYKCKVSNKALPAPIEKTISKAKGQPREPQVYVPPSREEMTKNQVS LLCLVKGFYPSDIAVEWESNGQPENNYLTWPPVLDSDGSFFLYSKLTVDKSRW QQGNVFSCSVMHEALHNHYTQKSLSLSPGK |
| 335 | TPP-1360 CD47 WHOLE LC | NIQMTQSPSSLSASVGDRVTITCRASQDIHRYLSWFQQKPGKVPKHLIYRESRF VDGVPSRFSGSGSGTEFTLTISSLQPEDFATYYCLQYDEFPYTFGGGTKVEIKRT VAAPSVFIFPPSDEELKSGTASVVCWLNNFYPREAKVQWKVDNALQSGNSEE SVTEQDSKDSTYSLSSTLELSKADYEKHKVYACEVTHQGLSSPVTKSFNRGEC |
| 336 | TPP-1360 CD47 WHOLE HC | QMQLVQSGAEVKKPGSSVKVSCKASGFNIKDYYLHWVRQAPGKGLEWMG WIDPDQGDTYYAQKFQGRVTITRDRSTSTAYMELRSLRAEDTAVYYCNAAYG ESSYPMDYWGQGTLVTVSSASTKGPSVFPLAPSSKSTSGGTAALGCLVKDYFP EPVTVSWNSGALTSGVHTFPAVLKSSGLYSLSSVVTVPSSSLGTQTYICNVNHK PSNTKVDKKVEPKSCDKTHTCPPCPAPELLGGPSVFLFPPKPKDTLMISRTPEVT CVVVDVSHEDPEVKFNWYVDGVEVHNAKTKPREEQYNSTYRVVSVLTVLHQ DWLNGKEYKCKVSNKALPAPIEKTISKAKGQPREPQVYVPPSREEMTKNQVS LLCLVKGFYPSDIAVEWESNGQPENNYLTWPPVLDSDGSFFLYSKLTVDKSRW QQGNVFSCSVMHEALHNHYTQKSLSLSPGK |
| 337 | TPP-1367 CD47 WHOLE LC | NIQMTQSPSSLSASVGDRVTITCRASQDIHRYLSWFQQKPGKVPKHLIYRANR LVSGVPSRFSGSGSGTEFTLTISSLQPEDFATYYCLQYDEFPYTFGGGTKVEIKRT VAAPSVFIFPPSDEELKSGTASVVCWLNNFYPREAKVQWKVDNALQSGNSEE SVTEQDSKDSTYSLSSTLELSKADYEKHKVYACEVTHQGLSSPVTKSFNRGEC |

TABLE 2-continued

Sequence Listing

| SEQ ID NO: | Description | Amino Acid Sequence |
|---|---|---|
| 338 | TPP-1367 CD47 WHOLE HC | QMQLVQSGAEVKKPGSSVKVSCKASGFNIKDYYLHWVRQAPGKGLEWMG WIDPDQGDTYYAQKFQGRVTITRDRSTSTAYMELRSLRAEDTAVYYCNAAYG ESSYPMDYWGQGTLVTVSSASTKGPSVFPLAPSSKSTSGGTAALGCLVKDYFP EPVTVSWNSGALTSGVHTFPAVLKSSGLYSLSSVVTVPSSSLGTQTYICNVNHK PSNTKVDKKVEPKSCDKTHTCPPCPAPELLGGPSVFLFPPKPKDTLMISRTPEVT CVVVDVSHEDPEVKFNWYVDGVEVHNAKTKPREEQYNSTYRVVSVLTVLHQ DWLNGKEYKCKVSNKALPAPIEKTISKAKGQPREPQVYVLPPSREEMTKNQVS LLCLVKGFYPSDIAVEWESNGQPENNYLTWPPVLDSDGSFFLYSKLTVDKSRW QQGNVFSCSVMHEALHNHYTQKSLSLSPGK |
| 339 | anti-CD47 IgG1 LC Constant Region | RTVAAPSVFIFPPSDEELKSGTASVVCWLNNFYPREAKVQWKVDNALQSGNS EESVTEQDSKDSTYSLSSTLELSKADYEKHKVYACEVTHQGLSSPVTKSFNRGEC |
| 340 | anti-CD47 IgG1 LC Constant Region-underlined portion of SEQ ID NO: 339 | ELKSGTASVVCWLNNFYPREAKVQWKVDNALQSGNSEESVTEQDSKDSTYSL SSTLE |
| 341 | anti-CD47 IgG1 HC Constant Region | ASTKGPSVFPLAPSSKSTSGGTAALGCLVKDYFPEPVTVSWNSGALTSGVHTFP AVLKSSGLYSLSSVVTVPSSSLGTQTYICNVNHKPSNTKVDKKVEPKSCDKTHTC PPCPAPELLGGPSVFLFPPKPKDTLMISRTPEVTCVVVDVSHEDPEVKFNWYV DGVEVHNAKTKPREEQYNSTYRVVSVLTVLHQDWLNGKEYKCKVSNKALPAP IEKTISKAKGQPREPQVYVLPPSREEMTKNQVSLLCLVKGFYPSDIAVEWESNG QPENNYLTWPPVLDSDGSFFLYSKLTVDKSRWQQGNVFSCSVMHEALHNHY TQKSLSLSPGK |
| 342 | anti-CD47 IgG1 HC Constant Region-underlined portion of SEQ ID NO: 341 | KSSGLYSLSSVVTVPSSSLGTQTYICNVNHKPSNTKVDKKVEPKSCDKTHTCPPC PAPELLGGPSVFLFPPKPKDTLMISRTPEVTCVVVDVSHEDPEVKFNWYVDGV EVHNAKTKPREEQYNSTYRVVSVLTVLHQDWLNGKEYKCKVSNKALPAPIEKTI SKAKGQPREPQVYVLPPSREEMTKNQVSLLCLVKGFYPSDIAVEWESNGQPE NNYLTW |
| 343 | anti-CD20 IgG1 LC Constant Region | RTVAAPSVAIFPPSDERLKSGTASVVCVLNNFYPREAKVQWKVDNALQSGNS QESVTEQDSKDSTYSLSSRLTLSKADYEKHKVYACEVTHQGLSSPVTKSFNRGE C |
| 344 | anti-CD20 IgG1 LC Constant Region-underlined portion of SEQ ID NO: 343 | AIFPPSDERLKSGTASVVCVLNNFYPREAKVQWKVDNALQSGNSQESVTEQD SKDSTYSLSSR |
| 345 | anti-CD20 IgG1 HC Constant Region | ASTKGPSVFPLAPSSKSTSGGTAWLGCEVTDYFPEPVTVSWNSGALTSGVHTF PAVLESSGLYSLSSVVTVPSSSLGTQTYICNVNHKPSNTKVDKKVEPKSCDKTHT CPPCPAPELLGGPSVFLFPPKPKDTLMISRTPEVTCVVVDVSHEDPEVKFNWYV DGVEVHNAKTKPREEQYNSTYRVVSVLTVLHQDWLNGKEYKCKVSNKALPAP IEKTISKAKGQPREPQVYVYPPSREEMTKNQVSLTCLVKGFYPSDIAVEWESNG QPENNYKTTPPVLDSDGSFALVSKLTVDKSRWQQGNVFSCSVMHEALHNHY TQKSLSLSPGK |
| 346 | | WLGCEVTDYFPEPVTVSWNSGALTSGVHTFPAVLESSGLYSLSSVVTVPSSSLG TQTYICNVNHKPSNTKVDKKVEPKSCDKTHTCPPCPAPELLGGPSVFLFPPKPK DTLMISRTPEVTCVVVDVSHEDPEVKFNWYVDGVEVHNAKTKPREEQYNSTY RVVSVLTVLHQDWLNGKEYKCKVSNKALPAPIEKTISKAKGQPREPQVYVYPPS REEMTKNQVSLTCLVKGFYPSDIAVEWESNGQPENNYKTTPPVLDSDGSFALV |
| 347 | 90002 VL CDR1 | KASQDIHRYLS |

TABLE 2-continued

Sequence Listing

| SEQ ID NO: | Description | Amino Acid Sequence |
|---|---|---|
| 348 | 90002 VL CDR2 | RANRLVS |
| 349 | 90002 VL CDR3 | LQYDEFPYT |
| 350 | 90002 VH CDR1 | DYYLH |
| 351 | 90002 VH CDR2 | WIDPDQGDTEYAQKFQD |
| 352 | 90002 VH CDR3 | AAYGSSSYPMDY |
| 353 | Rituximab CD20 VL CDR1 | RASSSVSYIH |
| 354 | Rituximab CD20 VL CDR2 | ATSNLAS |
| 355 | Rituximab CD20 VL CDR3 | QQWTSNPPT |
| 356 | Rituximab CD20 VH CDR1 | SYNMH |
| 357 | Rituximab CD20 VH CDR2 | AIYPGNGDTSYNQKFKG |
| 358 | Rituximab CD20 VH CDR3 | STYYGGDWYFNV |
| 359 | TPP-1361 CD47 VL CDR1 | QASQDIHRYLS |
| 360 | TPP-1361 CD47 VL CDR2 | RESRFVD |
| 361 | TPP-1361 CD47 VL CDR3 | LQYDEFPYT |
| 362 | TPP-1361 CD47 VH CDR1 | DYYLH |
| 363 | TPP-1361 CD47 VH CDR2 | WIDPDQGDTYYAQKFQG |
| 364 | TPP-1361 CD47 VH CDR3 | AYGESSYPMDY |
| 365 | TPP-1360 CD47 VL CDR1 | RASQDIHRYLS |
| 366 | TPP-1360 CD47 VL CDR2 | RESRFVD |
| 367 | TPP-1360 CD47 VL CDR3 | LQYDEFPYT |
| 368 | TPP-1360 CD47 VH CDR1 | DYYLH |
| 369 | TPP-1360 CD47 VH CDR2 | WIDPDQGDTYYAQKFQG |

TABLE 2-continued

Sequence Listing

| SEQ ID NO: | Description | Amino Acid Sequence |
|---|---|---|
| 370 | TPP-1360 CD47 VH CDR3 | AYGESSYPMDY |
| 371 | TPP-1367 CD47 VL CDR1 | RASQDIHRYLS |
| 372 | TPP-1367 CD47 VL CDR2 | RANRLVS |
| 373 | TPP-1367 CD47 VL CDR3 | LQYDEFPYT |
| 374 | TPP-1367 CD47 VH CDR1 | DYYLH |
| 375 | TPP-1367 CD47 VH CDR2 | WIDPDQGDTYYAQKFQG |
| 376 | TPP-1367 CD47 VH CDR3 | AYGESSYPMDY |
| 377 | TPP-1362 CD47 VL CDR1 | RASQGISSWLA |
| 378 | TPP-1362 CD47 VL CDR2 | AASVLES |
| 379 | TPP-1362 CD47 VL CDR3 | QQANSFPYT |
| 380 | TPP-1362 CD47 VH CDR1 | NFVMS |
| 381 | TPP-1362 CD47 VH CDR2 | TISGSGGSTYYADSVKG |
| 382 | TPP-1362 CD47 VH CDR3 | HYILRYFD |
| 383 | TPP-1362 CD47 VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 384 | TPP-1362 CD47 VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHYILRYF DWLAGTLVTVSS |
| 385 | TPP-1362 CD47 WHOLE LC | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIKR TVAAPSVFIFPPSDEELKSGTASVVCWLNNFYPREAKVQWKVDNALQSGNSE ESVTEQDSKDSTYSLSSTLELSKADYEKHKVYACEVTHQGLSSPVTKSFNRGEC |
| 386 | TPP-1362 CD47 WHOLE HC | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHYILRYF DWLAGTLVTVSSASTKGPSVFPLAPSSKSTSGGTAALGCLVKDYFPEPVTVSW NSGALTSGVHTFPAVLKSSGLYSLSSVVTVPSSSLGTQTYICNVNHKPSNTKVDK KVEPKSCDKTHTCPPCPAPELLGGPSVFLFPPKPKDTLMISRTPEVTCVVVDVS HEDPEVKFNWYVDGVEVHNAKTKPREEQYNSTYRVVSVLTVLHQDWLNGKE YKCKVSNKALPAPIEKTISKAKGQPREPQVYVLPPSREEMTKNQVSLLCLVKGFY PSDIAVEWESNGQPENNYLTWPPVLDSDGSFFLYSKLTVDKSRWQQGNVFSC SVMHEALHNHYTQKSLSLSPGK |
| 387 | CG_1_VL | DIQMTQSPSSVSASVGDRVTITCRASQGISSWLAWYQQKPGKAPKLLIYAASV LESGVPSRFSGSGSGTDFTLTISSLQPEDFATYYCQQANTFPYTFGQGTKLEIK |

TABLE 2-continued

Sequence Listing

| SEQ ID NO: | Description | Amino Acid Sequence |
|---|---|---|
| 388 | CG_1_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 389 | CG_2_VL | DIQMTQSPSSVSASVGDRVTITCRASQGISSWLAWYQQKPGKAPKLLIYAASV LESGVPSRFSGSGSGTDFTLTISSLQPEDFATYYCQQATSFPYTFGQGTKLEIK |
| 390 | CG_2_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 391 | CG_3_VL | DIQMTQSPSSVSASVGDRVTITCRASQGISSWLAWYQQKPGKAPKLLIYAASV LESGVPSRFSGSGSGTDFTLTISSLQPEDFATYYCQQAVEFPYTFGQGTKLEIK |
| 392 | CG_3_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 393 | CG_4_VL | DIQMTQSPSSVSASVGDRVTITCRASQGISSWLAWYQQKPGKAPKLLIYAASV LESGVPSRFSGSGSGTDFTLTISSLQPEDFATYYCQQAQVFPYTFGQGTKLEIK |
| 394 | CG_4_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 395 | CG_5_VL | DIQMTQSPSSVSASVGDRVTITCRASQGISSWLAWYQQKPGKAPKLLIYAASV LESGVPSRFSGSGSGTDFTLTISSLQPEDFATYYCQQATSAPYTFGQGTKLEIK |
| 396 | CG_5_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 397 | CG_6_VL | DIQMTQSPSSVSASVGDRVTITCRASQGISSWLAWYQQKPGKAPKLLIYAASV LESGVPSRFSGSGSGTDFTLTISSLQPEDFATYYCQQANTMPYTFGQGTKLEIK |
| 398 | CG_6_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 399 | CG_7_VL | DIQMTQSPSSVSASVGDRVTITCRASQGISSWLAWYQQKPGKAPKLLIYAASV LESGVPSRFSGSGSGTDFTLTISSLQPEDFATYYCQQATSVPYTFGQGTKLEIK |
| 400 | CG_7_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 401 | CG_8_VL | DIQMTQSPSSVSASVGDRVTITCRASQGISSWLAWYQQKPGKAPKLLIYAASV LESGVPSRFSGSGSGTDFTLTISSLQPEDFATYYCQQADSAPYTFGQGTKLEIK |
| 402 | CG_8_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 403 | CG_9_VL | DIQMTQSPSSVSASVGDRVTITCRASQGISSWLAWYQQKPGKAPKLLIYAASV LESGVPSRFSGSGSGTDFTLTISSLQPEDFATYYCQQADSVPYTFGQGTKLEIK |
| 404 | CG_9_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 405 | CG_10_VL | DIQMTQSPSSVSASVGDRVTITCRASQGISSWLAWYQQKPGKAPKLLIYAASV LESGVPSRFSGSGSGTDFTLTISSLQPEDFATYYCQQAVQFPYTFGQGTKLEIK |
| 406 | CG_10_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 407 | CG_11_VL | DIQMTQSPSSVSASVGDRVTITCRASQGISSWLAWYQQKPGKAPKLLIYAASV LESGVPSRFSGSGSGTDFTLTISSLQPEDFATYYCQQAVTFPYTFGQGTKLEIK |
| 408 | CG_11_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |

TABLE 2-continued

Sequence Listing

| SEQ ID NO: | Description | Amino Acid Sequence |
|---|---|---|
| 409 | CG_12_VL | DIQMTQSPSSVSASVGDRVTITCRASQGISSWLAWYQQKPGKAPKLLIYAASV LESGVPSRFSGSGSGTDFTLTISSLQPEDFATYYCQQANTAPYTFGQGTKLEIK |
| 410 | CG_12_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 411 | CG_13_VL | DIQMTQSPSSVSASVGDRVTITCRASQGISSWLAWYQQKPGKAPKLLIYASSV LESGVPSRFSGSGSGTDFTLTISSLQPEDFATYYCQQANSFPYTFGQGTKLEIK |
| 412 | CG_13_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 413 | CG_14_VL | DIQMTQSPSSVSASVGDRVTITCRASQGISSWLAWYQQKPGKAPKLLIYAASIL ESGVPSRFSGSGSGTDFTLTISSLQPEDFATYYCQQANSFPYTFGQGTKLEIK |
| 414 | CG_14_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 415 | CG_15_VL | DIQMTQSPSSVSASVGDRVTITCRASQGISSWLAWYQQKPGKAPKLLIYAASA LESGVPSRFSGSGSGTDFTLTISSLQPEDFATYYCQQANSFPYTFGQGTKLEIK |
| 416 | CG_15_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 417 | CG_16_VL | DIQMTQSPSSVSASVGDRVTITCRASQGISSWLAWYQQKPGKAPKLLIYAAEV LESGVPSRFSGSGSGTDFTLTISSLQPEDFATYYCQQANSFPYTFGQGTKLEIK |
| 418 | CG_16_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 419 | CG_17_VL | DIQMTQSPSSVSASVGDRVTITCRASQGISSWLAWYQQKPGKAPKLLIYAATV LESGVPSRFSGSGSGTDFTLTISSLQPEDFATYYCQQANSFPYTFGQGTKLEIK |
| 420 | CG_17_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 421 | CG_18_VL | DIQMTQSPSSVSASVGDRVTITCRASQGISSWLAWYQQKPGKAPKLLIYAAYV LESGVPSRFSGSGSGTDFTLTISSLQPEDFATYYCQQANSFPYTFGQGTKLEIK |
| 422 | CG_18_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 423 | CG_19_VL | DIQMTQSPSSVSASVGDRVTITCRASQGISSWLAWYQQKPGKAPKLLIYAAQI LESGVPSRFSGSGSGTDFTLTISSLQPEDFATYYCQQANSFPYTFGQGTKLEIK |
| 424 | CG_19_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 425 | CG_20_VL | DIQMTQSPSSVSASVGDRVTITCRASQGISSWLAWYQQKPGKAPKLLIYAATIL ESGVPSRFSGSGSGTDFTLTISSLQPEDFATYYCQQANSFPYTFGQGTKLEIK |
| 426 | CG_20_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 427 | CG_21_VL | DIQMTQSPSSVSASVGDRVTITCRASQGISSWLAWYQQKPGKAPKLLIYAAVF LESGVPSRFSGSGSGTDFTLTISSLQPEDFATYYCQQANSFPYTFGQGTKLEIK |
| 428 | CG_21_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 429 | CG22VL | DIQMTQSPSSVSASVGDRVTITCRASQGISSWLAWYQQKPGKAPKLLIYAAVY LESGVPSRFSGSGSGTDFTLTISSLQPEDFATYYCQQANSFPYTFGQGTKLEIK |

TABLE 2-continued

Sequence Listing

| SEQ ID NO: | Description | Amino Acid Sequence |
|---|---|---|
| 430 | CG_22_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 431 | CG_23_VL | DIQMTQSPSSVSASVGDRVTITCRASQGITSWLAWYQQKPGKAPKLLIYAASV LESGVPSRFSGSGSGTDFTLTISSLQPEDFATYYCQQANSFPYTFGQGTKLEIK |
| 432 | CG_23_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 433 | CG_24_VL | DIQMTQSPSSVSASVGDRVTITCRASQSISSWLAWYQQKPGKAPKLLIYAASVL ESGVPSRFSGSGSGTDFTLTISSLQPEDFATYYCQQANSFPYTFGQGTKLEIK |
| 434 | CG_24_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 435 | CG_25_VL | DIQMTQSPSSVSASVGDRVTITCRASQGVSSWLAWYQQKPGKAPKLLIYAAS VLESGVPSRFSGSGSGTDFTLTISSLQPEDFATYYCQQANSFPYTFGQGTKLEIK |
| 436 | CG_25_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 437 | CG_26_VL | DIQMTQSPSSVSASVGDRVTITCRASQGLSSWLAWYQQKPGKAPKLLIYAASV LESGVPSRFSGSGSGTDFTLTISSLQPEDFATYYCQQANSFPYTFGQGTKLEIK |
| 438 | CG_26_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 439 | CG_27_VL | DIQMTQSPSSVSASVGDRVTITCRASEGISSWLAWYQQKPGKAPKLLIYAASVL ESGVPSRFSGSGSGTDFTLTISSLQPEDFATYYCQQANSFPYTFGQGTKLEIK |
| 440 | CG_27_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 441 | CG_28_VL | DIQMTQSPSSVSASVGDRVTITCRASQYIESWLAWYQQKPGKAPKLLIYAASV LESGVPSRFSGSGSGTDFTLTISSLQPEDFATYYCQQANSFPYTFGQGTKLEIK |
| 442 | CG_28_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 443 | CG_29_VL | DIQMTQSPSSVSASVGDRVTITCRASQHITSWLAWYQQKPGKAPKLLIYAASV LESGVPSRFSGSGSGTDFTLTISSLQPEDFATYYCQQANSFPYTFGQGTKLEIK |
| 444 | CG_29_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 445 | CG_30_VL | DIQMTQSPSSVSASVGDRVTITCRATEGISSWLAWYQQKPGKAPKLLIYAASVL ESGVPSRFSGSGSGTDFTLTISSLQPEDFATYYCQQANSFPYTFGQGTKLEIK |
| 446 | CG_30_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 447 | CG_31_VL | DIQMTQSPSSVSASVGDRVTITCRASQYIQSWLAWYQQKPGKAPKLLIYAASV LESGVPSRFSGSGSGTDFTLTISSLQPEDFATYYCQQANSFPYTFGQGTKLEIK |
| 448 | CG_31_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |
| 449 | CG_32_VL | DIQMTQSPSSVSASVGDRVTITCRASQYISSWLAWYQQKPGKAPKLLIYAASV LESGVPSRFSGSGSGTDFTLTISSLQPEDFATYYCQQANSFPYTFGQGTKLEIK |
| 450 | CG_32_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHHILRYF DWLAGTLVTVSS |

TABLE 2-continued

Sequence Listing

| SEQ ID NO: | Description | Amino Acid Sequence |
|---|---|---|
| 451 | CG_33_VL | DIQMTQSPSSVSASVGDRVTITCRASQYIASWLAWYQQKPGKAPKLLIYAASV<br>LESGVPSRFSGSGSGTDFTLTISSLQPEDFATYYCQQANSFPYTFGQGTKLEIK |
| 452 | CG_33_VH | EVQLLESGGGLVQPGGSLRLSCAASGFTFPNFVMSWVRQAPGKGLEWVSTIS<br>GSGGSTYYADSVKGRFTISRDNSKNMLYLQMNSLRAEDTAVYYCAKHHILRYF<br>DWLAGTLVTVSS |
| 453 | CG_34_VL | DIQMTQSPSSVSASVGDRVTITCRASQYITSWLAWYQQKPGKAPKLLIYAASV<br>LESGVPSRFSGSGSGTDFTLTISSLQPEDFATYYCQQANSFPYTFGQGTKLEIK |
| 454 | CG_34_VH | EVQLLESGGGLVQPGGSLRLSCAASGFTFPNFVMSWVRQAPGKGLEWVSTIS<br>GSGGSTYYADSVKGRFTISRDNSKNMLYLQMNSLRAEDTAVYYCAKHHILRYF<br>DWLAGTLVTVSS |
| 455 | CG_35_VL | DIQMTQSPSSVSASVGDRVTITCRASQGISSWLAWYQQKPGKAPKLLIYAASV<br>LESGVPSRFSGSGSGTDFTLTISSLQPEDFATYYCQQANSFPYTFGQGTKLEIK |
| 456 | CG_35_VH | EVQLLESGGGLVQPGGSLRLSCAASGFTFPNFVMSWVRQAPGKGLEWVSTIS<br>GSGGSTYYADSVKGRFTISRDNSKNMLYLQMNSLRAEDTAVYYCAKHHILRYF<br>DWLAGTLVTVSS |
| 457 | CG_36_VL | DIQMTQSPSSVSASVGDRVTITCRASQGISSWLAWYQQKPGKAPKLLIYAASV<br>LESGVPSRFSGSGSGTDFTLTISSLQPEDFATYYCQQANSFPYTFGQGTKLEIK |
| 458 | CG_36_VH | EVQLLESGGGLVQPGGSLRLSCAASGFTFPNFVMSWVRQAPGKGLEWVSTIS<br>GSGGSTYYADSVKGRFTISRDNSKNMLYLQMNSLRAEDTAVYYCAKHSILRYF<br>DWLAGTLVTVSS |
| 459 | CG_37_VL | DIQMTQSPSSVSASVGDRVTITCRASQGISSWLAWYQQKPGKAPKLLIYAASV<br>LESGVPSRFSGSGSGTDFTLTISSLQPEDFATYYCQQANSFPYTFGQGTKLEIK |
| 460 | CG_37_VH | EVQLLESGGGLVQPGGSLRLSCAASGFTFPNFVMSWVRQAPGKGLEWVSTIS<br>GSGGSTYYADSVKGRFTISRDNSKNMLYLQMNSLRAEDTAVYYCAKHTILRYF<br>DWLAGTLVTVSS |
| 461 | CG_38_VL | DIQMTQSPSSVSASVGDRVTITCRASQGISSWLAWYQQKPGKAPKLLIYAASV<br>LESGVPSRFSGSGSGTDFTLTISSLQPEDFATYYCQQANSFPYTFGQGTKLEIK |
| 462 | CG_38_VH | EVQLLESGGGLVQPGGSLRLSCAASGFTFPNFVMSWVRQAPGKGLEWVSTIS<br>GSGGSTYYADSVKGRFTISRDNSKNMLYLQMNSLRAEDTAVYYCAKHHILRSF<br>DWLAGTLVTVSS |
| 463 | CG_39_VL | DIQMTQSPSSVSASVGDRVTITCRASQGISSWLAWYQQKPGKAPKLLIYAASV<br>LESGVPSRFSGSGSGTDFTLTISSLQPEDFATYYCQQANSFPYTFGQGTKLEIK |
| 464 | CG_39_VH | EVQLLESGGGLVQPGGSLRLSCAASGFTFPNFVMSWVRQAPGKGLEWVSTIS<br>GSGGSTYYADSVKGRFTISRDNSKNMLYLQMNSLRAEDTAVYYCAKHHILKYF<br>DWLAGTLVTVSS |
| 465 | CG_40_VL | DIQMTQSPSSVSASVGDRVTITCRASQGISSWLAWYQQKPGKAPKLLIYAASV<br>LESGVPSRFSGSGSGTDFTLTISSLQPEDFATYYCQQANSFPYTFGQGTKLEIK |
| 466 | CG_40_VH | EVQLLESGGGLVQPGGSLRLSCAASGFTFPNFVMSWVRQAPGKGLEWVSTIS<br>GSGGSTYYADSVKGRFTISRDNSKNMLYLQMNSLRAEDTAVYYCAKHHVIRYF<br>DWLAGTLVTVSS |
| 467 | CG_41_VL | DIQMTQSPSSVSASVGDRVTITCRASQGISSWLAWYQQKPGKAPKLLIYAASV<br>LESGVPSRFSGSGSGTDFTLTISSLQPEDFATYYCQQANSFPYTFGQGTKLEIK |
| 468 | CG_41_VH | EVQLLESGGGLVQPGGSLRLSCAASGFTFPNFVMSWVRQAPGKGLEWVSTIS<br>GSGGSTYYADSVKGRFTISRDNSKNMLYLQMNSLRAEDTAVYYCAKHVILRYF<br>DWLAGTLVTVSS |
| 469 | CG_42_VL | DIQMTQSPSSVSASVGDRVTITCRASQGISSWLAWYQQKPGKAPKLLIYAASV<br>LESGVPSRFSGSGSGTDFTLTISSLQPEDFATYYCQQANSFPYTFGQGTKLEIK |
| 470 | CG_42_VH | EVQLLESGGGLVQPGGSLRLSCAASGFTFPNFVMSWVRQAPGKGLEWVSTIS<br>GSGGSTYYADSVKGRFTISRDNSKNMLYLQMNSLRAEDTAVYYCAKHYILRYF<br>DWLAGTLVTVSS |
| 471 | CG_43_VL | DIQMTQSPSSVSASVGDRVTITCRASQGISSWLAWYQQKPGKAPKLLIYAASV<br>LESGVPSRFSGSGSGTDFTLTISSLQPEDFATYYCQQANSFPYTFGQGTKLEIK |

TABLE 2-continued

Sequence Listing

| SEQ ID NO: | Description | Amino Acid Sequence |
|---|---|---|
| 472 | CG_43_VH | EVQLLESGGGLVQPGGSLRLSCAASGFTFPNFVMSWVRQAPGKGLEWVSTIS GSGGSTYYADSVKGRFTISRDNSKNMLYLQMNSLRAEDTAVYYCAKHLYLRYF DWLAGTLVTVSS |
| 473 | CG_44_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 474 | CG_44_VH | EVQLLESGGGLVQPGGSLRLSCAASGFTFPNFVMSWVRQAPGKGLEWVSTIS GAGGSTYYADSVKGRFTISRDNSKNMLYLQMNSLRAEDTAVYYCAKHHILRYF DWLAGTLVTVSS |
| 475 | CG_45_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 476 | CG_45_VH | EVQLLESGGGLVQPGGSLRLSCAASGFTFPNFVMSWVRQAPGKGLEWVSTIS GSGGSSYYADSVKGRFTISRDNSKNMLYLQMNSLRAEDTAVYYCAKHHILRYF DWLAGTLVTVSS |
| 477 | CG_46_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 478 | CG_46_VH | EVQLLESGGGLVQPGGSLRLSCAASGFTFPNFVMSWVRQAPGKGLEWVSTIS GTGGSTYYADSVKGRFTISRDNSKNMLYLQMNSLRAEDTAVYYCAKHHILRYF DWLAGTLVTVSS |
| 479 | CG_47_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 480 | CG_47_VH | EVQLLESGGGLVQPGGSLRLSCAASGFTFPNFVMSWVRQAPGKGLEWVSTIS GTGSSTYYADSVKGRFTISRDNSKNMLYLQMNSLRAEDTAVYYCAKHHILRYF DWLAGTLVTVSS |
| 481 | CG_48_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 482 | CG_48_VH | EVQLLESGGGLVQPGGSLRLSCAASGFTFPNFVMSWVRQAPGKGLEWVSTIS GYGGSTYYADSVKGRFTISRDNSKNMLYLQMNSLRAEDTAVYYCAKHHILRYF DWLAGTLVTVSS |
| 483 | CG_49_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 484 | CG_49_VH | EVQLLESGGGLVQPGGSLRLSCAASGFTFPNFVMSWVRQAPGKGLEWVSTIS GHGGSTYYADSVKGRFTISRDNSKNMLYLQMNSLRAEDTAVYYCAKHHILRYF DWLAGTLVTVSS |
| 485 | CG_50_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 486 | CG_50_VH | EVQLLESGGGLVQPGGSLRLSCAASGFTFPNFVMSWVRQAPGKGLEWVSTIS GHGGATYYADSVKGRFTISRDNSKNMLYLQMNSLRAEDTAVYYCAKHHILRYF DWLAGTLVTVSS |
| 487 | CG_51_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 488 | CG_51_VH | EVQLLESGGGLVQPGGSLRLSCAASGFTFPNFVMSWVRQAPGKGLEWVSTIS GEGGLTYYADSVKGRFTISRDNSKNMLYLQMNSLRAEDTAVYYCAKHHILRYF DWLAGTLVTVSS |
| 489 | CG_52_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 490 | CG_52_VH | EVQLLESGGGLVQPGGSLRLSCAASGFTFPNFVMSWVRQAPGKGLEWVSTIS GHGGTTYYADSVKGRFTISRDNSKNMLYLQMNSLRAEDTAVYYCAKHHILRYF DWLAGTLVTVSS |
| 491 | CG_53_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 492 | CG_53_VH | EVQLLESGGGLVQPGGSLRLSCAASGFTFPNFVMSWVRQAPGKGLEWVSTIS GYGGTTYYADSVKGRFTISRDNSKNMLYLQMNSLRAEDTAVYYCAKHHILRYF DWLAGTLVTVSS |

TABLE 2-continued

Sequence Listing

| SEQ ID NO: | Description | Amino Acid Sequence |
|---|---|---|
| 493 | CG_54_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 494 | CG_54_VH | EVQLLESGGGLVQPGGSLRLSCAASGFTFPNFVMSWVRQAPGKGLEWVSTIS GYGGATYYADSVKGRFTISRDNSKNMLYLQMNSLRAEDTAVYYCAKHHILRYF DWLAGTLVTVSS |
| 495 | CG_55_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 496 | CG_55_VH | EVQLLESGGGLVQPGGSLRLSCAASGFTFPNFVMSWVRQAPGKGLEWVSTIS GDGGLTYYADSVKGRFTISRDNSKNMLYLQMNSLRAEDTAVYYCAKHHILRYF DWLAGTLVTVSS |
| 497 | CG_56_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 498 | CG_56_VH | EVQLLESGGGLVQPGGSLRLSCAASGFTFPNFVMSWVRQAPGKGLEWVSTIS GTGGLTYYADSVKGRFTISRDNSKNMLYLQMNSLRAEDTAVYYCAKHHILRYF DWLAGTLVTVSS |
| 499 | CG_57_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 500 | CG_57_VH | EVQLLESGGGLVQPGGSLRLSCAASGFTFPDFVMSWVRQAPGKGLEWVSTIS GSGGSTYYADSVKGRFTISRDNSKNMLYLQMNSLRAEDTAVYYCAKHHILRYF DWLAGTLVTVSS |
| 501 | CG_58_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 502 | CG_58_VH | EVQLLESGGGLVQPGGSLRLSCAASGFTFPEFVMSWVRQAPGKGLEWVSTIS GSGGSTYYADSVKGRFTISRDNSKNMLYLQMNSLRAEDTAVYYCAKHHILRYF DWLAGTLVTVSS |
| 503 | CG_59_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 504 | CG_59_VH | EVQLLESGGGLVQPGGSLRLSCAASGFTFPQFVMSWVRQAPGKGLEWVSTIS GSGGSTYYADSVKGRFTISRDNSKNMLYLQMNSLRAEDTAVYYCAKHHILRYF DWLAGTLVTVSS |
| 505 | CG_60_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 506 | CG_60_VH | EVQLLESGGGLVQPGGSLRLSCAASGFSFVNFVMSWVRQAPGKGLEWVSTIS GSGGSTYYADSVKGRFTISRDNSKNMLYLQMNSLRAEDTAVYYCAKHHILRYF DWLAGTLVTVSS |
| 507 | CG_61_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 508 | CG_61_VH | EVQLLESGGGLVQPGGSLRLSCAASGFTFVDFVMSWVRQAPGKGLEWVSTIS GSGGSTYYADSVKGRFTISRDNSKNMLYLQMNSLRAEDTAVYYCAKHHILRYF DWLAGTLVTVSS |
| 509 | CG_62_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 510 | CG_62_VH | EVQLLESGGGLVQPGGSLRLSCAASGFTFLDFVMSWVRQAPGKGLEWVSTIS GSGGSTYYADSVKGRFTISRDNSKNMLYLQMNSLRAEDTAVYYCAKHHILRYF DWLAGTLVTVSS |
| 511 | CG_63_VL | DIQMTQSPSSVSASVGDRVTITCRASQGISSWLAWYQQKPGKAPKLLIYAASV LESGVPSRFSGSGSGTDFTLTISSLQPEDFATYYCQQANSFPYTFGQGTKLEIK |
| 512 | CG_63_VH | EVQLLESGGGLVQPGGSLRLSCAASGFTFYEFVMSWVRQAPGKGLEWVSTIS GSGGSTYYADSVKGRFTISRDNSKNMLYLQMNSLRAEDTAVYYCAKHHILRYF DWLAGTLVTVSS |
| 513 | CG_1_VL_CDR1 | RASQGISSWLA |

TABLE 2-continued

Sequence Listing

| SEQ ID NO: | Description | Amino Acid Sequence |
|---|---|---|
| 514 | CG_1_VL_CDR2 | AASVLES |
| 515 | CG_1_VL_CDR3 | QQANTFPYT |
| 516 | CG_1_VH_CDR1 | NFVMS |
| 517 | CG_1_VH_CDR2 | TISGSGGSTYYADSVKG |
| 518 | CG_1_VH_CDR3 | HILRYFD |
| 519 | CG_2_VL_CDR1 | RASQGISSWLA |
| 520 | CG_2_VL_CDR2 | AASVLES |
| 521 | CG_2_VL_CDR3 | QQATSFPYT |
| 522 | CG_2_VH_CDR1 | NFVMS |
| 523 | CG_2_VH_CDR2 | TISGSGGSTYYADSVKG |
| 524 | CG_2_VH_CDR3 | HILRYFD |
| 525 | CG_3_VL_CDR1 | RASQGISSWLA |
| 526 | CG_3_VL_CDR2 | AASVLES |
| 527 | CG_3_VL_CDR3 | QQAVEFPYT |
| 528 | CG_3_VH_CDR1 | NFVMS |
| 529 | CG_3_VH_CDR2 | TISGSGGSTYYADSVKG |
| 530 | CG_3_VH_CDR3 | HILRYFD |
| 531 | CG_4_VL_CDR1 | RASQGISSWLA |
| 532 | CG_4_VL_CDR2 | AASVLES |
| 533 | CG_4_VL_CDR3 | QQAQVFPYT |
| 534 | CG_4_VH_CDR1 | NFVMS |
| 535 | CG_4_VH_CDR2 | TISGSGGSTYYADSVKG |
| 536 | CG_4_VH_CDR3 | HILRYFD |
| 537 | CG_5_VL_CDR1 | RASQGISSWLA |
| 538 | CG_5_VL_CDR2 | AASVLES |

TABLE 2-continued

Sequence Listing

| SEQ ID NO: | Description | Amino Acid Sequence |
|---|---|---|
| 539 | CG_5_VL_CDR3 | QQATSAPYT |
| 540 | CG_5_VH_CDR1 | NFVMS |
| 541 | CG_5_VH_CDR2 | TISGSGGSTYYADSVKG |
| 542 | CG_5_VH_CDR3 | HILRYFD |
| 543 | CG_6_VL_CDR1 | RASQGISSWLA |
| 544 | CG_6_VL_CDR2 | AASVLES |
| 545 | CG_6_VL_CDR3 | QQANTMPYT |
| 546 | CG_6_VH_CDR1 | NFVMS |
| 547 | CG_6_VH_CDR2 | TISGSGGSTYYADSVKG |
| 548 | CG_6_VH_CDR3 | HILRYFD |
| 549 | CG_7_VL_CDR1 | RASQGISSWLA |
| 550 | CG_7_VL_CDR2 | AASVLES |
| 551 | CG_7_VL_CDR3 | QQATSVPYT |
| 552 | CG_7_VH_CDR1 | NFVMS |
| 553 | CG_7_VH_CDR2 | TISGSGGSTYYADSVKG |
| 554 | CG_7_VH_CDR3 | HILRYFD |
| 555 | CG_8_VL_CDR1 | RASQGISSWLA |
| 556 | CG_8_VL_CDR2 | AASVLES |
| 557 | CG_8_VL_CDR3 | QQADSAPYT |
| 558 | CG_8_VH_CDR1 | NFVMS |
| 559 | CG_8_VH_CDR2 | TISGSGGSTYYADSVKG |
| 560 | CG_8_VH_CDR3 | HILRYFD |
| 561 | CG_9_VL_CDR1 | RASQGISSWLA |
| 562 | CG_9_VL_CDR2 | AASVLES |

TABLE 2-continued

Sequence Listing

| SEQ ID NO: | Description | Amino Acid Sequence |
|---|---|---|
| 563 | CG_9_VL_CDR3 | QQADSVPYT |
| 564 | CG_9_VH_CDR1 | NFVMS |
| 565 | CG_9_VH_CDR2 | TISGSGGSTYYADSVKG |
| 566 | CG_9_VH_CDR3 | HILRYFD |
| 567 | CG_10_VL_CDR1 | RASQGISSWLA |
| 568 | CG_10_VL_CDR2 | AASVLES |
| 569 | CG_10_VL_CDR3 | QQAVQFPYT |
| 570 | CG_10_VH_CDR1 | NFVMS |
| 571 | CG_10_VH_CDR2 | TISGSGGSTYYADSVKG |
| 572 | CG_10_VH_CDR3 | HILRYFD |
| 573 | CG_11_VL_CDR1 | RASQGISSWLA |
| 574 | CG_11_VL_CDR2 | AASVLES |
| 575 | CG_11_VL_CDR3 | QQAVTFPYT |
| 576 | CG_11_VH_CDR1 | NFVMS |
| 577 | CG_11_VH_CDR2 | TISGSGGSTYYADSVKG |
| 578 | CG_11_VH_CDR3 | HILRYFD |
| 579 | CG_12_VL_CDR1 | RASQGISSWLA |
| 580 | CG_12_VL_CDR2 | AASVLES |
| 581 | CG_12_VL_CDR3 | QQANTAPYT |
| 582 | CG_12_VH_CDR1 | NFVMS |
| 583 | CG_12_VH_CDR2 | TISGSGGSTYYADSVKG |
| 584 | CG_12_VH_CDR3 | HILRYFD |
| 585 | CG_13_VL_CDR1 | RASQGISSWLA |
| 586 | CG_13_VL_CDR2 | ASSVLES |

TABLE 2-continued

Sequence Listing

| SEQ ID NO: | Description | Amino Acid Sequence |
|---|---|---|
| 587 | CG_13_VL_CDR3 | QQANSFPYT |
| 588 | CG_13_VH_CDR1 | NFVMS |
| 589 | CG_13_VH_CDR2 | TISGSGGSTYYADSVKG |
| 590 | CG_13_VH_CDR3 | HILRYFD |
| 591 | CG_14_VL_CDR1 | RASQGISSWLA |
| 592 | CG_14_VL_CDR2 | AASILES |
| 593 | CG_14_VL_CDR3 | QQANSFPYT |
| 594 | CG_14_VH_CDR1 | NFVMS |
| 595 | CG_14_VH_CDR2 | TISGSGGSTYYADSVKG |
| 596 | CG_14_VH_CDR3 | HILRYFD |
| 597 | CG_15_VL_CDR1 | RASQGISSWLA |
| 598 | CG_15_VL_CDR2 | AASALES |
| 599 | CG_15_VL_CDR3 | QQANSFPYT |
| 600 | CG_15_VH_CDR1 | NFVMS |
| 601 | CG_15_VH_CDR2 | TISGSGGSTYYADSVKG |
| 602 | CG_15_VH_CDR3 | HILRYFD |
| 603 | CG_16_VL_CDR1 | RASQGISSWLA |
| 604 | CG_16_VL_CDR2 | AAEVLES |
| 605 | CG_16_VL_CDR3 | QQANSFPYT |
| 606 | CG_16_VH_CDR1 | NFVMS |
| 607 | CG_16_VH_CDR2 | TISGSGGSTYYADSVKG |
| 608 | CG_16_VH_CDR3 | HILRYFD |
| 609 | CG_17_VL_CDR1 | RASQGISSWLA |
| 610 | CG_17_VL_CDR2 | AATVLES |

TABLE 2-continued

Sequence Listing

| SEQ ID NO: | Description | Amino Acid Sequence |
|---|---|---|
| 611 | CG_17_VL_CDR3 | QQANSFPYT |
| 612 | CG_17_VH_CDR1 | NFVMS |
| 613 | CG_17_VH_CDR2 | TISGSGGSTYYADSVKG |
| 614 | CG_17_VH_CDR3 | HILRYFD |
| 615 | CG_18_VL_CDR1 | RASQGISSWLA |
| 616 | CG_18_VL_CDR2 | AAYVLES |
| 617 | CG_18_VL_CDR3 | QQANSFPYT |
| 618 | CG_18_VH_CDR1 | NFVMS |
| 619 | CG_18_VH_CDR2 | TISGSGGSTYYADSVKG |
| 620 | CG_18_VH_CDR3 | HILRYFD |
| 621 | CG_19_VL_CDR1 | RASQGISSWLA |
| 622 | CG_19_VL_CDR2 | AAQILES |
| 623 | CG_19_VL_CDR3 | QQANSFPYT |
| 624 | CG_19_VH_CDR1 | NFVMS |
| 625 | CG_19_VH_CDR2 | TISGSGGSTYYADSVKG |
| 626 | CG_19_VH_CDR3 | HILRYFD |
| 627 | CG_20_VL_CDR1 | RASQGISSWLA |
| 628 | CG_20_VL_CDR2 | AATILES |
| 629 | CG_20_VL_CDR3 | QQANSFPYT |
| 630 | CG_20_VH_CDR1 | NFVMS |
| 631 | CG_20_VH_CDR2 | TISGSGGSTYYADSVKG |
| 632 | CG_20_VH_CDR3 | HILRYFD |
| 633 | CG_21_VL_CDR1 | RASQGISSWLA |
| 634 | CG_21_VL_CDR2 | AAVFLES |

TABLE 2-continued

Sequence Listing

| SEQ ID NO: | Description | Amino Acid Sequence |
|---|---|---|
| 635 | CG_21_VL_CDR3 | QQANSFPYT |
| 636 | CG_21_VH_CDR1 | NFVMS |
| 637 | CG_21_VH_CDR2 | TISGSGGSTYYADSVKG |
| 638 | CG_21_VH_CDR3 | HILRYFD |
| 639 | CG_22_VL_CDR1 | RASQGISSWLA |
| 640 | CG_22_VL_CDR2 | AAVYLES |
| 641 | CG_22_VL_CDR3 | QQANSFPYT |
| 642 | CG_22_VH_CDR1 | NFVMS |
| 643 | CG_22_VH_CDR2 | TISGSGGSTYYADSVKG |
| 644 | CG_22_VH_CDR3 | HILRYFD |
| 645 | CG_23_VL_CDR1 | RASQGITSWLA |
| 646 | CG_23_VL_CDR2 | AASVLES |
| 647 | CG_23_VL_CDR3 | QQANSFPYT |
| 648 | CG_23_VH_CDR1 | NFVMS |
| 649 | CG_23_VH_CDR2 | TISGSGGSTYYADSVKG |
| 650 | CG_23_VH_CDR3 | HILRYFD |
| 651 | CG_24_VL_CDR1 | RASQSISSWLA |
| 652 | CG_24_VL_CDR2 | AASVLES |
| 653 | CG_24_VL_CDR3 | QQANSFPYT |
| 654 | CG_24_VH_CDR1 | NFVMS |
| 655 | CG_24_VH_CDR2 | TISGSGGSTYYADSVKG |
| 656 | CG_24_VH_CDR3 | HILRYFD |
| 657 | CG_25_VL_CDR1 | RASQGVSSWLA |
| 658 | CG_25_VL_CDR2 | AASVLES |

TABLE 2-continued

Sequence Listing

| SEQ ID NO: | Description | Amino Acid Sequence |
|---|---|---|
| 659 | CG_25_VL_CDR3 | QQANSFPYT |
| 660 | CG_25_VH_CDR1 | NFVMS |
| 661 | CG_25_VH_CDR2 | TISGSGGSTYYADSVKG |
| 662 | CG_25_VH_CDR3 | HILRYFD |
| 663 | CG_26_VL_CDR1 | RASQGLSSWLA |
| 664 | CG_26_VL_CDR2 | AASVLES |
| 665 | CG_26_VL_CDR3 | QQANSFPYT |
| 666 | CG_26_VH_CDR1 | NFVMS |
| 667 | CG_26_VH_CDR2 | TISGSGGSTYYADSVKG |
| 668 | CG_26_VH_CDR3 | HILRYFD |
| 669 | CG_27_VL_CDR1 | RASEGISSWLA |
| 670 | CG_27_VL_CDR2 | AASVLES |
| 671 | CG_27_VL_CDR3 | QQANSFPYT |
| 672 | CG_27_VH_CDR1 | NFVMS |
| 673 | CG_27_VH_CDR2 | TISGSGGSTYYADSVKG |
| 674 | CG_27_VH_CDR3 | HILRYFD |
| 675 | CG_28_VL_CDR1 | RASQYIESWLA |
| 676 | CG_28_VL_CDR2 | AASVLES |
| 677 | CG_28_VL_CDR3 | QQANSFPYT |
| 678 | CG_28_VH_CDR1 | NFVMS |
| 679 | CG_28_VH_CDR2 | TISGSGGSTYYADSVKG |
| 680 | CG_28_VH_CDR3 | HILRYFD |
| 681 | CG_29_VL_CDR1 | RASQHITSWLA |
| 682 | CG_29_VL_CDR2 | AASVLES |

TABLE 2-continued

Sequence Listing

| SEQ ID NO: | Description | Amino Acid Sequence |
|---|---|---|
| 683 | CG_29_VL_CDR3 | QQANSFPYT |
| 684 | CG_29_VH_CDR1 | NFVMS |
| 685 | CG_29_VH_CDR2 | TISGSGGSTYYADSVKG |
| 686 | CG_29_VH_CDR3 | HILRYFD |
| 687 | CG_30_VL_CDR1 | RATEGISSWLA |
| 688 | CG_30_VL_CDR2 | AASVLES |
| 689 | CG_30_VL_CDR3 | QQANSFPYT |
| 690 | CG_30_VH_CDR1 | NFVMS |
| 691 | CG_30_VH_CDR2 | TISGSGGSTYYADSVKG |
| 692 | CG_30_VH_CDR3 | HILRYFD |
| 693 | CG_31_VL_CDR1 | RASQYIQSWLA |
| 694 | CG_31_VL_CDR2 | AASVLES |
| 695 | CG_31_VL_CDR3 | QQANSFPYT |
| 696 | CG_31_VH_CDR1 | NFVMS |
| 697 | CG_31_VH_CDR2 | TISGSGGSTYYADSVKG |
| 698 | CG_31_VH_CDR3 | HILRYFD |
| 699 | CG_32_VL_CDR1 | RASQYISSWLA |
| 700 | CG_32_VL_CDR2 | AASVLES |
| 701 | CG_32_VL_CDR3 | QQANSFPYT |
| 702 | CG_32_VH_CDR1 | NFVMS |
| 703 | CG_32_VH_CDR2 | TISGSGGSTYYADSVKG |
| 704 | CG_32_VH_CDR3 | HILRYFD |
| 705 | CG_33_VL_CDR1 | RASQYIASWLA |
| 706 | CG_33_VL_CDR2 | AASVLES |

TABLE 2-continued

Sequence Listing

| SEQ ID NO: | Description | Amino Acid Sequence |
|---|---|---|
| 707 | CG_33_VL_CDR3 | QQANSFPYT |
| 708 | CG_33_VH_CDR1 | NFVMS |
| 709 | CG_33_VH_CDR2 | TISGSGGSTYYADSVKG |
| 710 | CG_33_VH_CDR3 | HILRYFD |
| 711 | CG_34_VL_CDR1 | RASQYITSWLA |
| 712 | CG_34_VL_CDR2 | AASVLES |
| 713 | CG_34_VL_CDR3 | QQANSFPYT |
| 714 | CG_34_VH_CDR1 | NFVMS |
| 715 | CG_34_VH_CDR2 | TISGSGGSTYYADSVKG |
| 716 | CG_34_VH_CDR3 | HILRYFD |
| 717 | CG_35_VL_CDR1 | RASQGISSWLA |
| 718 | CG_35_VL_CDR2 | AASVLES |
| 719 | CG_35_VL_CDR3 | QQANSFPYT |
| 720 | CG_35_VH_CDR1 | NFVMS |
| 721 | CG_35_VH_CDR2 | TISGSGGSTYYADSVKG |
| 722 | CG_35_VH_CDR3 | HILRYFD |
| 723 | CG_36_VL_CDR1 | RASQGISSWLA |
| 724 | CG_36_VL_CDR2 | AASVLES |
| 725 | CG_36_VL_CDR3 | QQANSFPYT |
| 726 | CG_36_VH_CDR1 | NFVMS |
| 727 | CG_36_VH_CDR2 | TISGSGGSTYYADSVKG |
| 728 | CG_36_VH_CDR3 | HSILRYFD |
| 729 | CG_37_VL_CDR1 | RASQGISSWLA |
| 730 | CG_37_VL_CDR2 | AASVLES |

TABLE 2-continued

Sequence Listing

| SEQ ID NO: | Description | Amino Acid Sequence |
|---|---|---|
| 731 | CG_37_VL_CDR3 | QQANSFPYT |
| 732 | CG_37_VH_CDR1 | NFVMS |
| 733 | CG_37_VH_CDR2 | TISGSGGSTYYADSVKG |
| 734 | CG_37_VH_CDR3 | HTILRYFD |
| 735 | CG_38_VL_CDR1 | RASQGISSWLA |
| 736 | CG_38_VL_CDR2 | AASVLES |
| 737 | CG_38_VL_CDR3 | QQANSFPYT |
| 738 | CG_38_VH_CDR1 | NFVMS |
| 739 | CG_38_VH_CDR2 | TISGSGGSTYYADSVKG |
| 740 | CG_38_VH_CDR3 | HILRSFD |
| 741 | CG_39_VL_CDR1 | RASQGISSWLA |
| 742 | CG_39_VL_CDR2 | AASVLES |
| 743 | CG_39_VL_CDR3 | QQANSFPYT |
| 744 | CG_39_VH_CDR1 | NFVMS |
| 745 | CG_39_VH_CDR2 | TISGSGGSTYYADSVKG |
| 746 | CG_39_VH_CDR3 | HILKYFD |
| 747 | CG_40_VL_CDR1 | RASQGISSWLA |
| 748 | CG_40_VL_CDR2 | AASVLES |
| 749 | CG_40_VL_CDR3 | QQANSFPYT |
| 750 | CG_40_VH_CDR1 | NFVMS |
| 751 | CG_40_VH_CDR2 | TISGSGGSTYYADSVKG |
| 752 | CG_40_VH_CDR3 | HVIRYFD |
| 753 | CG_41_VL_CDR1 | RASQGISSWLA |
| 754 | CG_41_VL_CDR2 | AASVLES |

TABLE 2-continued

Sequence Listing

| SEQ ID NO: | Description | Amino Acid Sequence |
|---|---|---|
| 755 | CG_41_VL_CDR3 | QQANSFPYT |
| 756 | CG_41_VH_CDR1 | NFVMS |
| 757 | CG_41_VH_CDR2 | TISGSGGSTYYADSVKG |
| 758 | CG_41_VH_CDR3 | HVILRYFD |
| 759 | CG_42_VL_CDR1 | RASQGISSWLA |
| 760 | CG_42_VL_CDR2 | AASVLES |
| 761 | CG_42_VL_CDR3 | QQANSFPYT |
| 762 | CG_42_VH_CDR1 | NFVMS |
| 763 | CG_42_VH_CDR2 | TISGSGGSTYYADSVKG |
| 764 | CG_42_VH_CDR3 | HYILRYFD |
| 765 | CG_43_VL_CDR1 | RASQGISSWLA |
| 766 | CG_43_VL_CDR2 | AASVLES |
| 767 | CG_43_VL_CDR3 | QQANSFPYT |
| 768 | CG_43_VH_CDR1 | NFVMS |
| 769 | CG_43_VH_CDR2 | TISGSGGSTYYADSVKG |
| 770 | CG_43_VH_CDR3 | HLYLRYFD |
| 771 | CG_44_VL_CDR1 | RASQGISSWLA |
| 772 | CG_44_VL_CDR2 | AASVLES |
| 773 | CG_44_VL_CDR3 | QQANSFPYT |
| 774 | CG_44_VH_CDR1 | NFVMS |
| 775 | CG_44_VH_CDR2 | TISGAGGSTYYADSVKG |
| 776 | CG_44_VH_CDR3 | HILRYFD |
| 777 | CG_45_VL_CDR1 | RASQGISSWLA |
| 778 | CG_45_VL_CDR2 | AASVLES |

TABLE 2-continued

Sequence Listing

| SEQ ID NO: | Description | Amino Acid Sequence |
|---|---|---|
| 779 | CG_45_VL_CDR3 | QQANSFPYT |
| 780 | CG_45_VH_CDR1 | NFVMS |
| 781 | CG_45_VH_CDR2 | TISGSGGSSYYADSVKG |
| 782 | CG_45_VH_CDR3 | HILRYFD |
| 783 | CG_46_VL_CDR1 | RASQGISSWLA |
| 784 | CG_46_VL_CDR2 | AASVLES |
| 785 | CG_46_VL_CDR3 | QQANSFPYT |
| 786 | CG_46_VH_CDR1 | NFVMS |
| 787 | CG_46_VH_CDR2 | TISGTGGSTYYADSVKG |
| 788 | CG_46_VH_CDR3 | HILRYFD |
| 789 | CG_47_VL_CDR1 | RASQGISSWLA |
| 790 | CG_47_VL_CDR2 | AASVLES |
| 791 | CG_47_VL_CDR3 | QQANSFPYT |
| 792 | CG_47_VH_CDR1 | NFVMS |
| 793 | CG_47_VH_CDR2 | TISGTGSSTYYADSVKG |
| 794 | CG_47_VH_CDR3 | HILRYFD |
| 795 | CG_48_VL_CDR1 | RASQGISSWLA |
| 796 | CG_48_VL_CDR2 | AASVLES |
| 797 | CG_48_VL_CDR3 | QQANSFPYT |
| 798 | CG_48_VH_CDR1 | NFVMS |
| 799 | CG_48_VH_CDR2 | TISGYGGSTYYADSVKG |
| 800 | CG_48_VH_CDR3 | HILRYFD |
| 801 | CG_49_VL_CDR1 | RASQGISSWLA |
| 802 | CG_49_VL_CDR2 | AASVLES |

TABLE 2-continued

Sequence Listing

| SEQ ID NO: | Description | Amino Acid Sequence |
|---|---|---|
| 803 | CG_49_VL_CDR3 | QQANSFPYT |
| 804 | CG_49_VH_CDR1 | NFVMS |
| 805 | CG_49_VH_CDR2 | TISGHGGSTYYADSVKG |
| 806 | CG_49_VH_CDR3 | HILRYFD |
| 807 | CG_50_VL_CDR1 | RASQGISSWLA |
| 808 | CG_50_VL_CDR2 | AASVLES |
| 809 | CG_50_VL_CDR3 | QQANSFPYT |
| 810 | CG_50_VH_CDR1 | NFVMS |
| 811 | CG_50_VH_CDR2 | TISGHGGATYYADSVKG |
| 812 | CG_50_VH_CDR3 | HILRYFD |
| 813 | CG_51_VL_CDR1 | RASQGISSWLA |
| 814 | CG_51_VL_CDR2 | AASVLES |
| 815 | CG_51_VL_CDR3 | QQANSFPYT |
| 816 | CG_51_VH_CDR1 | NFVMS |
| 817 | CG_51_VH_CDR2 | TISGEGGLTYYADSVKG |
| 818 | CG_51_VH_CDR3 | HILRYFD |
| 819 | CG_52_VL_CDR1 | RASQGISSWLA |
| 820 | CG_52_VL_CDR2 | AASVLES |
| 821 | CG_52_VL_CDR3 | QQANSFPYT |
| 822 | CG_52_VH_CDR1 | NFVMS |
| 823 | CG_52_VH_CDR2 | TISGHGGTTYYADSVKG |
| 824 | CG_52_VH_CDR3 | HILRYFD |
| 825 | CG_53_VL_CDR1 | RASQGISSWLA |
| 826 | CG_53_VL_CDR2 | AASVLES |

TABLE 2-continued

Sequence Listing

| SEQ ID NO: | Description | Amino Acid Sequence |
|---|---|---|
| 827 | CG_53_VL_CDR3 | QQANSFPYT |
| 828 | CG_53_VH_CDR1 | NFVMS |
| 829 | CG_53_VH_CDR2 | TISGYGGTTYYADSVKG |
| 830 | CG_53_VH_CDR3 | HILRYFD |
| 831 | CG_54_VL_CDR1 | RASQGISSWLA |
| 832 | CG_54_VL_CDR2 | AASVLES |
| 833 | CG_54_VL_CDR3 | QQANSFPYT |
| 834 | CG_54_VH_CDR1 | NFVMS |
| 835 | CG_54_VH_CDR2 | TISGYGGATYYADSVKG |
| 836 | CG_54_VH_CDR3 | HILRYFD |
| 837 | CG_55_VL_CDR1 | RASQGISSWLA |
| 838 | CG_55_VL_CDR2 | AASVLES |
| 839 | CG_55_VL_CDR3 | QQANSFPYT |
| 840 | CG_55_VH_CDR1 | NFVMS |
| 841 | CG_55_VH_CDR2 | TISGDGGLTYYADSVKG |
| 842 | CG_55_VH_CDR3 | HILRYFD |
| 843 | CG_56_VL_CDR1 | RASQGISSWLA |
| 844 | CG_56_VL_CDR2 | AASVLES |
| 845 | CG_56_VL_CDR3 | QQANSFPYT |
| 846 | CG_56_VH_CDR1 | NFVMS |
| 847 | CG_56_VH_CDR2 | TISGTGGLTYYADSVKG |
| 848 | CG_56_VH_CDR3 | HILRYFD |
| 849 | CG_57_VL_CDR1 | RASQGISSWLA |
| 850 | CG_57_VL_CDR2 | AASVLES |

TABLE 2-continued

Sequence Listing

| SEQ ID NO: | Description | Amino Acid Sequence |
|---|---|---|
| 851 | CG_57_VL_CDR3 | QQANSFPYT |
| 852 | CG_57_VH_CDR1 | DFVMS |
| 853 | CG_57_VH_CDR2 | TISGSGGSTYYADSVKG |
| 854 | CG_57_VH_CDR3 | HILRYFD |
| 855 | CG_58_VL_CDR1 | RASQGISSWLA |
| 856 | CG_58_VL_CDR2 | AASVLES |
| 857 | CG_58_VL_CDR3 | QQANSFPYT |
| 858 | CG_58_VH_CDR1 | EFVMS |
| 859 | CG_58_VH_CDR2 | TISGSGGSTYYADSVKG |
| 860 | CG_58_VH_CDR3 | HILRYFD |
| 861 | CG_59_VL_CDR1 | RASQGISSWLA |
| 862 | CG_59_VL_CDR2 | AASVLES |
| 863 | CG_59_VL_CDR3 | QQANSFPYT |
| 864 | CG_59_VH_CDR1 | QFVMS |
| 865 | CG_59_VH_CDR2 | TISGSGGSTYYADSVKG |
| 866 | CG_59_VH_CDR3 | HILRYFD |
| 867 | CG_60_VL_CDR1 | RASQGISSWLA |
| 868 | CG_60_VL_CDR2 | AASVLES |
| 869 | CG_60_VL_CDR3 | QQANSFPYT |
| 870 | CG_60_VH_CDR1 | VNFVMS |
| 871 | CG_60_VH_CDR2 | TISGSGGSTYYADSVKG |
| 872 | CG_60_VH_CDR3 | HILRYFD |
| 873 | CG_61_VL_CDR1 | RASQGISSWLA |
| 874 | CG_61_VL_CDR2 | AASVLES |

TABLE 2-continued

Sequence Listing

| SEQ ID NO: | Description | Amino Acid Sequence |
|---|---|---|
| 875 | CG_61_VL_CDR3 | QQANSFPYT |
| 876 | CG_61_VH_CDR1 | VDFVMS |
| 877 | CG_61_VH_CDR2 | TISGSGGSTYYADSVKG |
| 878 | CG_61_VH_CDR3 | HILRYFD |
| 879 | CG_62_VL_CDR1 | RASQGISSWLA |
| 880 | CG_62_VL_CDR2 | AASVLES |
| 881 | CG_62_VL_CDR3 | QQANSFPYT |
| 882 | CG_62_VH_CDR1 | LDFVMS |
| 883 | CG_62_VH_CDR2 | TISGSGGSTYYADSVKG |
| 884 | CG_62_VH_CDR3 | HILRYFD |
| 885 | CG_63_VL_CDR1 | RASQGISSWLA |
| 886 | CG_63_VL_CDR2 | AASVLES |
| 887 | CG_63_VL_CDR3 | QQANSFPYT |
| 888 | CG_63_VH_CDR1 | YEFVMS |
| 889 | CG_63_VH_CDR2 | TISGSGGSTYYADSVKG |
| 890 | CG_63_VH_CDR3 | HILRYFD |
| 891 | Anti-CD47 CL-4033_VL | DIQMTQSPSSVSASVGDRVTITCRASQGISSWLAWYQQKPGKAPKLLIYAASVLESGVPSRFSGSGSGTDFTLTISSLQPEDFATYYCQQANSFPYTFGQGTKLEIK |
| 892 | Anti-CD47 CL-4033_VH | EVQLLESGGGLVQPGGSLRLSCAASGFTFPNFVMSWVRQAPGKGLEWVSTISGSGGSTYYADSVKGRFTISRDNSKNMLYLQMNSLRAEDTAVYYCAKHHILRYFDWLAGTLVTVSS |
| 893 | Anti-CD47 CL-4033 VL CDR1 | RASQGISSWLA |
| 894 | Anti-CD47 CL-4033 VL CDR2 | AASVLES |
| 895 | Anti-CD47 CL-4033 VL CDR3 | QQANSFPYT |
| 896 | Anti-CD47 CL-4033 VH CDR1 | NFVMS |
| 897 | Anti-CD47 CL-4033 VH CDR2 | TISGSGGSTYYADSVKG |

TABLE 2-continued

Sequence Listing

| SEQ ID NO: | Description | Amino Acid Sequence |
|---|---|---|
| 898 | Anti-CD47 CL-4033 VH CDR3 | HHILRYFD |
| 899 | 408_437 VL | NIQMTQSPSSLSASVGDRVTITCRASQDIHRYLSWFQQKPGKVPKHLIYRANR LVSGVPSRFSGSGSGTEFTLTISSLQPEDFATYYCLQYDEFPYTFGGGTKVEIK |
| 900 | 408_437 VH | QMQLVQSGAEVKKPGSSVKVSCKASGFNIKDYYLHWVRQAPGKGLEWMG WIDPDQGDTEYAQKFQGRVTITRDRSTSTAYIVIELRSLRAEDTAVYYCNAAYG SSSYPMDYWGQGTLVTVSS |

All publications and patents referred to herein are incorporated by reference. Various modifications and variations of the described subject matter will be apparent to those skilled in the art without departing from the scope and spirit of the invention. Although the invention has been described in connection with specific embodiments, it should be understood that the invention as claimed should not be unduly limited to these embodiments. Indeed, various modifications for carrying out the invention are obvious to those skilled in the art and are intended to be within the scope of the following claims.

SEQUENCE LISTING (900 sequences)

SEQ ID NO: 1 - protein, 107 aa, Artificial Sequence
  CG_64_VL
NIQMTQSPSSLSASVGDRVTITCRASQDIHRYLSWFQQKPGKVPKHLIYRANRLVSGVPSRFSGSGSGTEFTLTISSLQPEDFATYYCLQYAEFPYTFGGGTKVEIK

SEQ ID NO: 2 - protein, 120 aa, Artificial Sequence
  CG_64_VH
QMQLVQSGAEVKKPGSSVKVSCKASGFNIKDYYLHWVRQAPGKGLEWMGYIDPEQGDTEYAQKFQGRVTITRDRSTSTAYMELRSLRAEDTAVYYCNAAYGSSSYPMDYWGQGTLVTVSS

SEQ ID NO: 3 - protein, 107 aa, Artificial Sequence
  CG_65_VL
NIQMTQSPSSLSASVGDRVTITCRASQDIHRYLSWFQQKPGKVPKHLIYRANRLVSGVPSRFSGSGSGTEFTLTISSLQPEDFATYYCLQYQEFPYTFGGGTKVEIK

SEQ ID NO: 4 - protein, 120 aa, Artificial Sequence
  CG_65_VH
QMQLVQSGAEVKKPGSSVKVSCKASGFNIKDYYLHWVRQAPGKGLEWMGYIDPTQGDTHYAQKFQGRVTITRDRSTSTAYMELRSLRAEDTAVYYCNAAYGSSSYPMDYWGQGTLVTVSS

SEQ ID NO: 5 - protein, 107 aa, Artificial Sequence
  CG_66_VL
NIQMTQSPSSLSASVGDRVTITCRASQDIHRYLSWFQQKPGKVPKHLIYRANRLVSGVPSRFSGSGSGTEFTLTISSLQPEDFATYYCLQYEEFPYTFGGGTKVEIK

SEQ ID NO: 6 - protein, 120 aa, Artificial Sequence
  CG_66_VH
QMQLVQSGAEVKKPGSSVKVSCKASGFNIKDYYLHWVRQAPGKGLEWMGYIDPSQGDTVYAQKFQGRVTITRDRSTSTAYMELRSLRAEDTAVYYCNAAYGSSSYPMDYWGQGTLVTVSS

SEQ ID NO: 7 - protein, 107 aa, Artificial Sequence
  CG_67_VL
NIQMTQSPSSLSASVGDRVTITCRASQDIHDYLSWFQQKPGKVPKHLIYRANILVSGVPSRFSGSGSGTEFTLTISSLQPEDFATYYCLQYDEFPYTFGGGTKVEIK

SEQ ID NO: 8 - protein, 120 aa, Artificial Sequence
  CG_67_VH
QMQLVQSGAEVKKPGSSVKVSCKASGFNIKDYYLHWVRQAPGKGLEWMGWIYPDQGVTEYAQKFQGRVTITRDRSTSTAYMELRSLRAEDTAVYYCNAAYGSSSYPMDYWGQGTLVTVSS

SEQ ID NO: 9 - protein, 107 aa, Artificial Sequence
  CG_68_VL
NIQMTQSPSSLSASVGDRVTITCRASQDIHDYLSWFQQKPGKVPKHLIYRANLLVSGVPSRFSGSGSGTEFTLTISSLQPEDFATYYCLQYDEFPYTFGGGTKVEIK

SEQ ID NO: 10 - protein, 120 aa, Artificial Sequence
  CG_68_VH
QMQLVQSGAEVKKPGSSVKVSCKASGFNIKDYYLHWVRQAPGKGLEWMGWIEPDQGATEYAQKFQGRVTITRDRSTSTAYMELRSLRAEDTAVYYCNAAYGSSSYPMDYWGQGTLVTVSS

SEQ ID NO: 11 - protein, 107 aa, Artificial Sequence
  CG_69_VL
NIQMTQSPSSLSASVGDRVTITCRASQDIHDYLSWFQQKPGKVPKHLIYRANYLVSGVPSRFSGSGSGTEFTLTISSLQPEDFATYYCLQYDEFPYTFGGGTKVEIK

SEQ ID NO: 12 - protein, 120 aa, Artificial Sequence
  CG_69_VH
QMQLVQSGAEVKKPGSSVKVSCKASGFNIKDYYLHWVRQAPGKGLEWMGWIHPDQGITEYAQKFQGRVTITRDRSTSTAYMELRSLRAEDTAVYYCNAAYGSSSYPMDYWGQGTLVTVSS

SEQ ID NO: 13 - protein, 107 aa, Artificial Sequence
  CG_70_VL
NIQMTQSPSSLSASVGDRVTITCRASQDIHEYLSWFQQKPGKVPKHLIYRANALVSGVPSRFSGSGSGTEFTLTISSLQPEDFATYYCLQYDEFPYTFGGGTKVEIK

SEQ ID NO: 14 - protein, 120 aa, Artificial Sequence
  CG_70_VH
QMQLVQSGAEVKKPGSSVKVSCKASGFNIKDYYLHWVRQAPGKGLEWMGWILPDQGVTEYAQKFQGRVTITRDRSTSTAYMELRSLRAEDTAVYYCNAAYGSSSYPMDYWGQGTLVTVSS

SEQ ID NO: 15 - protein, 107 aa, Artificial Sequence
  CG_71_VL
NIQMTQSPSSLSASVGDRVTITCRASQDIHEYLSWFQQKPGKVPKHLIYRANILVSGVPSRFSGSGSGTEFTLTISSLQPEDFATYYCLQYDEFPYTFGGGTKVEIK

SEQ ID NO: 16 - protein, 120 aa, Artificial Sequence
  CG_71_VH
QMQLVQSGAEVKKPGSSVKVSCKASGFNIKDYYLHWVRQAPGKGLEWMGWIEPDQGITEYAQKFQGRVTITRDRSTSTAYMELRSLRAEDTAVYYCNAAYGSSSYPMDYWGQGTLVTVSS

SEQ ID NO: 17 - protein, 107 aa, Artificial Sequence
  CG_72_VL
NIQMTQSPSSLSASVGDRVTITCRASQDIHEYLSWFQQKPGKVPKHLIYRANLLVSGVPSRFSGSGSGTEFTLTISSLQPEDFATYYCLQYDEFPYTFGGGTKVEIK

SEQ ID NO: 18 - protein, 120 aa, Artificial Sequence
  CG_72_VH
QMQLVQSGAEVKKPGSSVKVSCKASGFNIKDYYLHWVRQAPGKGLEWMGWILPDQGITEYAQKFQGRVTITRDRSTSTAYMELRSLRAEDTAVYYCNAAYGSSSYPMDYWGQGTLVTVSS

SEQ ID NO: 19 - protein, 107 aa, Artificial Sequence
  CG_73_VL
NIQMTQSPSSLSASVGDRVTITCRASQDIHEYLSWFQQKPGKVPKHLIYRANQLVSGVPSRFSGSGSGTEFTLTISSLQPEDFATYYCLQYDEFPYTFGGGTKVEIK

SEQ ID NO: 20 - protein, 120 aa, Artificial Sequence
  CG_73_VH
QMQLVQSGAEVKKPGSSVKVSCKASGFNIKDYYLHWVRQAPGKGLEWMGWIIPDQGMTEYAQKFQGRVTITRDRSTSTAYMELRSLRAEDTAVYYCNAAYGSSSYPMDYWGQGTLVTVSS

SEQ ID NO: 21 - protein, 107 aa, Artificial Sequence
  CG_74_VL
NIQMTQSPSSLSASVGDRVTITCRASQDIHEYLSWFQQKPGKVPKHLIYRANVLVSGVPSRFSGSGSGTEFTLTISSLQPEDFATYYCLQYDEFPYTFGGGTKVEIK

SEQ ID NO: 22 - protein, 120 aa, Artificial Sequence
  CG_74_VH
QMQLVQSGAEVKKPGSSVKVSCKASGFNIKDYYLHWVRQAPGKGLEWMGWIMPDQGLTEYAQKFQGRVTITRDRSTSTAYMELRSLRAEDTAVYYCNAAYGSSSYPMDYWGQGTLVTVSS

SEQ ID NO: 23 - protein, 107 aa, Artificial Sequence
  CG_75_VL
NIQMTQSPSSLSASVGDRVTITCRASQDIHEYLSWFQQKPGKVPKHLIYRANYLVSGVPSRFSGSGSGTEFTLTISSLQPEDFATYYCLQYDEFPYTFGGGTKVEIK

SEQ ID NO: 24 - protein, 120 aa, Artificial Sequence
  CG_75_VH
QMQLVQSGAEVKKPGSSVKVSCKASGFNIKDYYLHWVRQAPGKGLEWMGWIMPDQGITEYAQKFQGRVTITRDRSTSTAYMELRSLRAEDTAVYYCNAAYGSSSYPMDYWGQGTLVTVSS

SEQ ID NO: 25 - protein, 107 aa, Artificial Sequence
  CG_76_VL
NIQMTQSPSSLSASVGDRVTITCRASQDIHIYLSWFQQKPGKVPKHLIYRANDLVSGVPSRFSGSGSGTEFTLTISSLQPEDFATYYCLQYDEFPYTFGGGTKVEIK

SEQ ID NO: 26 - protein, 120 aa, Artificial Sequence
  CG_76_VH
QMQLVQSGAEVKKPGSSVKVSCKASGFNIKDYYLHWVRQAPGKGLEWMGWIMPDQGMTEYAQKFQGRVTITRDRSTSTAYMELRSLRAEDTAVYYCNAAYGSSSYPMDYWGQGTLVTVSS

SEQ ID NO: 27 - protein, 107 aa, Artificial Sequence
  CG_77_VL
NIQMTQSPSSLSASVGDRVTITCRASQDIHIYLSWFQQKPGKVPKHLIYRANTLVSGVPSRFSGSGSGTEFTLTISSLQPEDFATYYCLQYDEFPYTFGGGTKVEIK

SEQ ID NO: 28 - protein, 120 aa, Artificial Sequence
  CG_77_VH
QMQLVQSGAEVKKPGSSVKVSCKASGFNIKDYYLHWVRQAPGKGLEWMGWIYPDQGMTEYAQKFQGRVTITRDRSTSTAYMELRSLRAEDTAVYYCNAAYGSSSYPMDYWGQGTLVTVSS

SEQ ID NO: 29 - protein, 107 aa, Artificial Sequence
  CG_78_VL
NIQMTQSPSSLSASVGDRVTITCRASQDIHLYLSWFQQKPGKVPKHLIYRANDLVSGVPSRFSGSGSGTEFTLTISSLQPEDFATYYCLQYDEFPYTFGGGTKVEIK

SEQ ID NO: 30 - protein, 120 aa, Artificial Sequence
  CG_78_VH
QMQLVQSGAEVKKPGSSVKVSCKASGFNIKDYYLHWVRQAPGKGLEWMGWIQPDQGLTEYAQKFQGRVTITRDRSTSTAYMELRSLRAEDTAVYYCNAAYGSSSYPMDYWGQGTLVTVSS

SEQ ID NO: 31 - protein, 107 aa, Artificial Sequence
  CG_79_VL
NIQMTQSPSSLSASVGDRVTITCRASQDIHLYLSWFQQKPGKVPKHLIYRANELVSGVPSRFSGSGSGTEFTLTISSLQPEDFATYYCLQYDEFPYTFGGGTKVEIK

SEQ ID NO: 32 - protein, 120 aa, Artificial Sequence
  CG_79_VH
QMQLVQSGAEVKKPGSSVKVSCKASGFNIKDYYLHWVRQAPGKGLEWMGWIEPDQGYTEYAQKFQGRVTITRDRSTSTAYMELRSLRAEDTAVYYCNAAYGSSSYPMDYWGQGTLVTVSS

SEQ ID NO: 33 - protein, 107 aa, Artificial Sequence
  CG_80_VL
NIQMTQSPSSLSASVGDRVTITCRASQDIHNYLSWFQQKPGKVPKHLIYRANELVSGVPSRFSGSGSGTEFTLTISSLQPEDFATYYCLQYDEFPYTFGGGTKVEIK

SEQ ID NO: 34 - protein, 120 aa, Artificial Sequence
  CG_80_VH
QMQLVQSGAEVKKPGSSVKVSCKASGFNIKDYYLHWVRQAPGKGLEWMGWILPDQGYTEYAQKFQGRVTITRDRSTSTAYMELRSLRAEDTAVYYCNAAYGSSSYPMDYWGQGTLVTVSS

SEQ ID NO: 35 - protein, 107 aa, Artificial Sequence
  CG_81_VL
NIQMTQSPSSLSASVGDRVTITCRASQDIHNYLSWFQQKPGKVPKHLIYRANVLVSGVPSRFSGSGSGTEFTLTISSLQPEDFATYYCLQYDEFPYTFGGGTKVEIK

SEQ ID NO: 36 - protein, 120 aa, Artificial Sequence
  CG_81_VH
QMQLVQSGAEVKKPGSSVKVSCKASGFNIKDYYLHWVRQAPGKGLEWMGWIFPDQGMTEYAQKFQGRVTITRDRSTSTAYMELRSLRAEDTAVYYCNAAYGSSSYPMDYWGQGTLVTVSS

SEQ ID NO: 37 - protein, 107 aa, Artificial Sequence
  CG_82_VL
NIQMTQSPSSLSASVGDRVTITCRASQDIHQYLSWFQQKPGKVPKHLIYRANDLVSGVPSRFSGSGSGTEFTLTISSLQPEDFATYYCLQYDEFPYTFGGGTKVEIK

SEQ ID NO: 38 - protein, 120 aa, Artificial Sequence
  CG_82_VH
QMQLVQSGAEVKKPGSSVKVSCKASGFNIKDYYLHWVRQAPGKGLEWMGWIYPDQGITEYAQKFQGRVTITRDRSTSTAYMELRSLRAEDTAVYYCNAAYGSSSYPMDYWGQGTLVTVSS

SEQ ID NO: 39 - protein, 107 aa, Artificial Sequence
  CG_83_VL
NIQMTQSPSSLSASVGDRVTITCRASQDIHQYLSWFQQKPGKVPKHLIYRANELVSGVPSRFSGSGSGTEFTLTISSLQPEDFATYYCLQYDEFPYTFGGGTKVEIK

SEQ ID NO: 40 - protein, 120 aa, Artificial Sequence
  CG_83_VH
QMQLVQSGAEVKKPGSSVKVSCKASGFNIKDYYLHWVRQAPGKGLEWMGWIFPDQGQTEYAQKFQGRVTITRDRSTSTAYMELRSLRAEDTAVYYCNAAYGSSSYPMDYWGQGTLVTVSS

SEQ ID NO: 41 - protein, 107 aa, Artificial Sequence
  CG_84_VL
NIQMTQSPSSLSASVGDRVTITCRASQDIHTYLSWFQQKPGKVPKHLIYRANDLVSGVPSRFSGSGSGTEFTLTISSLQPEDFATYYCLQYDEFPYTFGGGTKVEIK

SEQ ID NO: 42 - protein, 120 aa, Artificial Sequence
  CG_84_VH
QMQLVQSGAEVKKPGSSVKVSCKASGFNIKDYYLHWVRQAPGKGLEWMGWIYPDQGLTEYAQKFQGRVTITRDRSTSTAYMELRSLRAEDTAVYYCNAAYGSSSYPMDYWGQGTLVTVSS

SEQ ID NO: 43 - protein, 107 aa, Artificial Sequence
  CG_85_VL
NIQMTQSPSSLSASVGDRVTITCRASQDIHTYLSWFQQKPGKVPKHLIYRANYLVSGVPSRFSGSGSGTEFTLTISSLQPEDFATYYCLQYDEFPYTFGGGTKVEIK

SEQ ID NO: 44 - protein, 120 aa, Artificial Sequence
  CG_85_VH
QMQLVQSGAEVKKPGSSVKVSCKASGFNIKDYYLHWVRQAPGKGLEWMGWIHPDQGLTEYAQKFQGRVTITRDRSTSTAYMELRSLRAEDTAVYYCNAAYGSSSYPMDYWGQGTLVTVSS

SEQ ID NO: 45 - protein, 107 aa, Artificial Sequence
  CG_86_VL
NIQMTQSPSSLSASVGDRVTITCRASQDIHVYLSWFQQKPGKVPKHLIYRANDLVSGVPSRFSGSGSGTEFTLTISSLQPEDFATYYCLQYDEFPYTFGGGTKVEIK

SEQ ID NO: 46 - protein, 120 aa, Artificial Sequence
  CG_86_VH
QMQLVQSGAEVKKPGSSVKVSCKASGFNIKDYYLHWVRQAPGKGLEWMGWIHPDQGVTEYAQKFQGRVTITRDRSTSTAYMELRSLRAEDTAVYYCNAAYGSSSYPMDYWGQGTLVTVSS

SEQ ID NO: 47 - protein, 107 aa, Artificial Sequence
  CG_87_VL
NIQMTQSPSSLSASVGDRVTITCRASQDIHYYLSWFQQKPGKVPKHLIYRANDLVSGVPSRFSGSGSGTEFTLTISSLQPEDFATYYCLQYDEFPYTFGGGTKVEIK

SEQ ID NO: 48 - protein, 120 aa, Artificial Sequence
  CG_87_VH
QMQLVQSGAEVKKPGSSVKVSCKASGFNIKDYYLHWVRQAPGKGLEWMGWIYPDQGATEYAQKFQGRVTITRDRSTSTAYMELRSLRAEDTAVYYCNAAYGSSSYPMDYWGQGTLVTVSS

SEQ ID NO: 49 - protein, 107 aa, Artificial Sequence
  CG_88_VL
NIQMTQSPSSLSASVGDRVTITCRASQDIHVYLSWFQQKPGKVPKHLIYRANQLVSGVPSRFSGSGSGTEFTLTISSLQPEDFATYYCLQYDEFPYTFGGGTKVEIK

SEQ ID NO: 50 - protein, 120 aa, Artificial Sequence; identical to SEQ ID NO: 48
  CG_88_VH

SEQ ID NO: 51 - protein, 107 aa, Artificial Sequence; identical to SEQ ID NO: 43
  CG_89_VL

SEQ ID NO: 52 - protein, 120 aa, Artificial Sequence
  CG_89_VH
QMQLVQSGAEVKKPGSSVKVSCKASGFNIKDYYLHWVRQAPGKGLEWMGWISPDQGSTEYAQKFQGRVTITRDRSTSTAYMELRSLRAEDTAVYYCNAAYGSSSYPMDYWGQGTLVTVSS

SEQ ID NO: 53 - protein, 107 aa, Artificial Sequence; identical to SEQ ID NO: 23
  CG_90_VL

SEQ ID NO: 54 - protein, 120 aa, Artificial Sequence
  CG_90_VH
QMQLVQSGAEVKKPGSSVKVSCKASGFNIKDYYLHWVRQAPGKGLEWMGWIMPDQGYTEYAQKFQGRVTITRDRSTSTAYMELRSLRAEDTAVYYCNAAYGSSSYPMDYWGQGTLVTVSS

SEQ ID NO: 55 - protein, 107 aa, Artificial Sequence
  CG_91_VL
NIQMTQSPSSLSASVGDRVTITCRASQDIHLYLSWFQQKPGKVPKHLIYRANQLVSGVPSRFSGSGSGTEFTLTISSLQPEDFATYYCLQYDEFPYTFGGGTKVEIK

SEQ ID NO: 56 - protein, 120 aa, Artificial Sequence
  CG_91_VH
QMQLVQSGAEVKKPGSSVKVSCKASGFNIKDYYLHWVRQAPGKGLEWMGWIIPDQGYTEYAQKFQGRVTITRDRSTSTAYMELRSLRAEDTAVYYCNAAYGSSSYPMDYWGQGTLVTVSS

SEQ ID NO: 57 - protein, 107 aa, Artificial Sequence
  CG_92_VL
NIQMTQSPSSLSASVGDRVTITCRASQDIHVYLSWFQQKPGKVPKHLIYRANELVSGVPSRFSGSGSGTEFTLTISSLQPEDFATYYCLQYDEFPYTFGGGTKVEIK

SEQ ID NO: 58 - protein, 120 aa, Artificial Sequence
  CG_92_VH
QMQLVQSGAEVKKPGSSVKVSCKASGFNIKDYYLHWVRQAPGKGLEWMGWIEPDQGMTEYAQKFQGRVTITRDRSTSTAYMELRSLRAEDTAVYYCNAAYGSSSYPMDYWGQGTLVTVSS

SEQ ID NO: 59 - protein, 107 aa, Artificial Sequence
  CG_93_VL
NIQMTQSPSSLSASVGDRVTITCRASQDIHHYLSWFQQKPGKVPKHLIYRANYLVSGVPSRFSGSGSGTEFTLTISSLQPEDFATYYCLQYDEFPYTFGGGTKVEIK

SEQ ID NO: 60 - protein, 120 aa, Artificial Sequence
  CG_93_VH
QMQLVQSGAEVKKPGSSVKVSCKASGFNIKDYYLHWVRQAPGKGLEWMGWIAPDQGVTEYAQKFQGRVTITRDRSTSTAYMELRSLRAEDTAVYYCNAAYGSSSYPMDYWGQGTLVTVSS

SEQ ID NO: 61 - protein, 107 aa, Artificial Sequence; identical to SEQ ID NO: 49
  CG_94_VL

SEQ ID NO: 62 - protein, 120 aa, Artificial Sequence
  CG_94_VH
QMQLVQSGAEVKKPGSSVKVSCKASGFNIKDYYLHWVRQAPGKGLEWMGWIVPDQGMTEYAQKFQGRVTITRDRSTSTAYMELRSLRAEDTAVYYCNAAYGSSSYPMDYWGQGTLVTVSS

SEQ ID NO: 63 - protein, 107 aa, Artificial Sequence; identical to SEQ ID NO: 43
  CG_95_VL

SEQ ID NO: 64 - protein, 120 aa, Artificial Sequence
  CG_95_VH
QMQLVQSGAEVKKPGSSVKVSCKASGFNIKDYYLHWVRQAPGKGLEWMGWIAPDQGITEYAQKFQGRVTITRDRSTSTAYMELRSLRAEDTAVYYCNAAYGSSSYPMDYWGQGTLVTVSS

SEQ ID NO: 65 - protein, 107 aa, Artificial Sequence
  CG_96_VL
NIQMTQSPSSLSASVGDRVTITCRASQDIHIYLSWFQQKPGKVPKHLIYRANELVSGVPSRFSGSGSGTEFTLTISSLQPEDFATYYCLQYDEFPYTFGGGTKVEIK

SEQ ID NO: 66 - protein, 120 aa, Artificial Sequence
  CG_96_VH
QMQLVQSGAEVKKPGSSVKVSCKASGFNIKDYYLHWVRQAPGKGLEWMGWIMPDQGATEYAQKFQGRVTITRDRSTSTAYMELRSLRAEDTAVYYCNAAYGSSSYPMDYWGQGTLVTVSS

SEQ ID NO: 67 - protein, 107 aa, Artificial Sequence
  CG_97_VL
NIQMTQSPSSLSASVGDRVTITCRASQDIHYYLSWFQQKPGKVPKHLIYRANELVSGVPSRFSGSGSGTEFTLTISSLQPEDFATYYCLQYDEFPYTFGGGTKVEIK

SEQ ID NO: 68 - protein, 120 aa, Artificial Sequence
  CG_97_VH
QMQLVQSGAEVKKPGSSVKVSCKASGFNIKDYYLHWVRQAPGKGLEWMGWIVPDQGITEYAQKFQGRVTITRDRSTSTAYMELRSLRAEDTAVYYCNAAYGSSSYPMDYWGQGTLVTVSS

SEQ ID NO: 69 - protein, 107 aa, Artificial Sequence
  CG_98_VL
NIQMTQSPSSLSASVGDRVTITCRASQDIHHYLSWFQQKPGKVPKHLIYRANDLVSGVPSRFSGSGSGTEFTLTISSLQPEDFATYYCLQYDEFPYTFGGGTKVEIK

SEQ ID NO: 70 - protein, 120 aa, Artificial Sequence; identical to SEQ ID NO: 38
  CG_98_VH

SEQ ID NO: 71 - protein, 107 aa, Artificial Sequence; identical to SEQ ID NO: 67
  CG_99_VL

SEQ ID NO: 72 - protein, 120 aa, Artificial Sequence; identical to SEQ ID NO: 8
  CG_99_VH

SEQ ID NO: 73 - protein, 107 aa, Artificial Sequence; identical to SEQ ID NO: 25
  CG_100_VL

SEQ ID NO: 74 - protein, 120 aa, Artificial Sequence
  CG_100_VH
QMQLVQSGAEVKKPGSSVKVSCKASGFNIKDYYLHWVRQAPGKGLEWMGWIEPDQGLTEYAQKFQGRVTITRDRSTSTAYMELRSLRAEDTAVYYCNAAYGSSSYPMDYWGQGTLVTVSS

SEQ ID NO: 75 - protein, 107 aa, Artificial Sequence; identical to SEQ ID NO: 47
  CG_101_VL

SEQ ID NO: 76 - protein, 120 aa, Artificial Sequence
  CG_101_VH
QMQLVQSGAEVKKPGSSVKVSCKASGFNIKDYYLHWVRQAPGKGLEWMGWILPDQGDTEYAQKFQGRVTITRDRSTSTAYMELRSLRAEDTAVYYCNAAYGSSSYPMDYWGQGTLVTVSS

SEQ ID NO: 77 - protein, 107 aa, Artificial Sequence; identical to SEQ ID NO: 45
  CG_102_VL

SEQ ID NO: 78 - protein, 120 aa, Artificial Sequence
  CG_102_VH
QMQLVQSGAEVKKPGSSVKVSCKASGFNIKDYYLHWVRQAPGKGLEWMGWIYPDQGSTEYAQKFQGRVTITRDRSTSTAYMELRSLRAEDTAVYYCNAAYGSSSYPMDYWGQGTLVTVSS

SEQ ID NO: 79 - protein, 107 aa, Artificial Sequence
  CG_103_VL
NIQMTQSPSSLSASVGDRVTITCRASQDIHIYLSWFQQKPGKVPKHLIYRANQLVSGVPSRFSGSGSGTEFTLTISSLQPEDFATYYCLQYDEFPYTFGGGTKVEIK

SEQ ID NO: 80 - protein, 120 aa, Artificial Sequence
  CG_103_VH
QMQLVQSGAEVKKPGSSVKVSCKASGFNIKDYYLHWVRQAPGKGLEWMGWIDPDQGATEYAQKFQGRVTITRDRSTSTAYMELRSLRAEDTAVYYCNAAYGSSSYPMDYWGQGTLVTVSS

SEQ ID NO: 81 - protein, 107 aa, Artificial Sequence; identical to SEQ ID NO: 29
  CG_104_VL

SEQ ID NO: 82 - protein, 120 aa, Artificial Sequence
  CG_104_VH
QMQLVQSGAEVKKPGSSVKVSCKASGFNIKDYYLHWVRQAPGKGLEWMGWIQPDQGVTEYAQKFQGRVTITRDRSTSTAYMELRSLRAEDTAVYYCNAAYGSSSYPMDYWGQGTLVTVSS

SEQ ID NO: 83 - protein, 107 aa, Artificial Sequence; identical to SEQ ID NO: 31
  CG_105_VL

SEQ ID NO: 84 - protein, 120 aa, Artificial Sequence
  CG_105_VH
QMQLVQSGAEVKKPGSSVKVSCKASGFNIKDYYLHWVRQAPGKGLEWMGWIIPDQGETEYAQKFQGRVTITRDRSTSTAYMELRSLRAEDTAVYYCNAAYGSSSYPMDYWGQGTLVTVSS

SEQ ID NO: 85 - protein, 107 aa, Artificial Sequence; identical to SEQ ID NO: 11
  CG_106_VL

SEQ ID NO: 86 - protein, 120 aa, Artificial Sequence
  CG_106_VH
QMQLVQSGAEVKKPGSSVKVSCKASGFNIKDYYLHWVRQAPGKGLEWMGWIIPDQGTTEYAQKFQGRVTITRDRSTSTAYMELRSLRAEDTAVYYCNAAYGSSSYPMDYWGQGTLVTVSS

SEQ ID NO: 87 - protein, 107 aa, Artificial Sequence
  CG_107_VL
NIQMTQSPSSLSASVGDRVTITCRASQDIHTYLSWFQQKPGKVPKHLIYRANQLVSGVPSRFSGSGSGTEFTLTISSLQPEDFATYYCLQYDEFPYTFGGGTKVEIK

SEQ ID NO: 88 - protein, 120 aa, Artificial Sequence; identical to SEQ ID NO: 56
  CG_107_VH

SEQ ID NO: 89 - protein, 107 aa, Artificial Sequence
  CG_108_VL
NIQMTQSPSSLSASVGDRVTITCRASQDIHRYLSWFQQKPGKVPKHLIYRANRLVSGVPSRFSGSGSGTEFTLTISSLQPEDFATYYCLQYDEFPYTFGGGTKVEIK

SEQ ID NO: 90 - protein, 120 aa, Artificial Sequence
  CG_108_VH
QMQLVQSGAEVKKPGSSVKVSCKASGFNIKDYYLHWVRQAPGKGLEWMGWIDPDQGDTYYAQKFQGRVTITRDRSTSTAYMELRSLRAEDTAVYYCNAAYGDSSYPMDYWGQGTLVTVSS

SEQ ID NO: 91 - protein, 107 aa, Artificial Sequence; identical to SEQ ID NO: 89
  CG_109_VL

SEQ ID NO: 92 - protein, 120 aa, Artificial Sequence
  CG_109_VH
QMQLVQSGAEVKKPGSSVKVSCKASGFNIKDYYLHWVRQAPGKGLEWMGWIDPDQGDTQYAQKFQGRVTITRDRSTSTAYMELRSLRAEDTAVYYCNAAYGYSSYPMDYWGQGTLVTVSS

SEQ ID NO: 93 - protein, 107 aa, Artificial Sequence; identical to SEQ ID NO: 89
  CG_110_VL

SEQ ID NO: 94 - protein, 120 aa, Artificial Sequence
  CG_110_VH
QMQLVQSGAEVKKPGSSVKVSCKASGFNIKDYYLHWVRQAPGKGLEWMGWIDPDQGDTLYAQKFQGRVTITRDRSTSTAYMELRSLRAEDTAVYYCNAAYGESSYPMDYWGQGTLVTVSS

SEQ ID NO: 95 - protein, 107 aa, Artificial Sequence; identical to SEQ ID NO: 89
  CG_111_VL

SEQ ID NO: 96 - protein, 120 aa, Artificial Sequence
  CG_111_VH
QMQLVQSGAEVKKPGSSVKVSCKASGFNIKDYYLHWVRQAPGKGLEWMGWIDPDQGDTVYAQKFQGRVTITRDRSTSTAYMELRSLRAEDTAVYYCNAAYGESSYPMDYWGQGTLVTVSS

SEQ ID NO: 97 - protein, 107 aa, Artificial Sequence; identical to SEQ ID NO: 89
  CG_112_VL

SEQ ID NO: 98 - protein, 120 aa, Artificial Sequence
  CG_112_VH
QMQLVQSGAEVKKPGSSVKVSCKASGFNIKDYYLHWVRQAPGKGLEWMGWIDPQQGDTEYAQKFQGRVTITRDRSTSTAYMELRSLRAEDTAVYYCNAAYGVSSYPMDYWGQGTLVTVSS

SEQ ID NO: 99 - protein, 107 aa, Artificial Sequence; identical to SEQ ID NO: 89
  CG_113_VL

SEQ ID NO: 100 - protein, 120 aa, Artificial Sequence
  CG_113_VH
QMQLVQSGAEVKKPGSSVKVSCKASGFNIKDYYLHWVRQAPGKGLEWMGWILPDQGDTEYAQKFQGRVTITRDRSTSTAYMELRSLRAEDTAVYYCNAAYGYSSYPMDYWGQGTLVTVSS

SEQ ID NO: 101 - protein, 107 aa, Artificial Sequence; identical to SEQ ID NO: 89
  CG_114_VL

SEQ ID NO: 102 - protein, 120 aa, Artificial Sequence
  CG_114_VH
QMQLVQSGAEVKKPGSSVKVSCKASGFNIKDYYLHWVRQAPGKGLEWMGWIDPDQGATYYAQKFQGRVTITRDRSTSTAYMELRSLRAEDTAVYYCNAAYGSSSYPMDYWGQGTLVTVSS

SEQ ID NO: 103 - protein, 107 aa, Artificial Sequence; identical to SEQ ID NO: 89
  CG_115_VL

SEQ ID NO: 104 - protein, 120 aa, Artificial Sequence
  CG_115_VH
QMQLVQSGAEVKKPGSSVKVSCKASGFNIKDYYLHWVRQAPGKGLEWMGWIDPDTGDTEYAQKFQGRVTITRDRSTSTAYMELRSLRAEDTAVYYCNAAYYSSSYPMDYWGQGTLVTVSS

SEQ ID NO: 105 - protein, 107 aa, Artificial Sequence; identical to SEQ ID NO: 89
  CG_116_VL

SEQ ID NO: 106 - protein, 120 aa, Artificial Sequence
  CG_116_VH
QMQLVQSGAEVKKPGSSVKVSCKASGFNIKDYYLHWVRQAPGKGLEWMGWIDPDQGDTSYAQKFQGRVTITRDRSTSTAYMELRSLRAEDTAVYYCNAAYGYSSYPMDYWGQGTLVTVSS

SEQ ID NO: 107 - protein, 107 aa, Artificial Sequence; identical to SEQ ID NO: 89
  CG_117_VL

SEQ ID NO: 108 - protein, 120 aa, Artificial Sequence
  CG_117_VH
QMQLVQSGAEVKKPGSSVKVSCKASGFNIKDYYLHWVRQAPGKGLEWMGWIDPDQGDTAYAQKFQGRVTITRDRSTSTAYMELRSLRAEDTAVYYCNAAYGLSSYPMDYWGQGTLVTVSS

SEQ ID NO: 109 - protein, 107 aa, Artificial Sequence; identical to SEQ ID NO: 89
  CG_118_VL

SEQ ID NO: 110 - protein, 120 aa, Artificial Sequence
  CG_118_VH
QMQLVQSGAEVKKPGSSVKVSCKASGFNIKDYYLHWVRQAPGKGLEWMGWIDPDVGSTEYAQKFQGRVTITRDRSTSTAYMELRSLRAEDTAVYYCNAAYGSSSYPMDYWGQGTLVTVSS

SEQ ID NO: 111 - protein, 107 aa, Artificial Sequence; identical to SEQ ID NO: 89
  CG_119_VL

SEQ ID NO: 112 - protein, 120 aa, Artificial Sequence
  CG_119_VH
QMQLVQSGAEVKKPGSSVKVSCKASGFNIKDYYLHWVRQAPGKGLEWMGWIDPDQGATSYAQKFQGRVTITRDRSTSTAYMELRSLRAEDTAVYYCNAAYGSSSYPMDYWGQGTLVTVSS

SEQ ID NO: 113 - protein, 107 aa, Artificial Sequence; identical to SEQ ID NO: 89
  CG_120_VL

SEQ ID NO: 114 - protein, 120 aa, Artificial Sequence
  CG_120_VH
QMQLVQSGAEVKKPGSSVKVSCKASGFNIKDYYLHWVRQAPGKGLEWMGWILPDSGDTEYAQKFQGRVTITRDRSTSTAYMELRSLRAEDTAVYYCNAAYGSSSYPMDYWGQGTLVTVSS

SEQ ID NO: 115 - protein, 107 aa, Artificial Sequence; identical to SEQ ID NO: 89
  CG_121_VL

SEQ ID NO: 116 - protein, 120 aa, Artificial Sequence
  CG_121_VH
QMQLVQSGAEVKKPGSSVKVSCKASGFNIKDYYLHWVRQAPGKGLEWMGWIDPDLGDTSYAQKFQGRVTITRDRSTSTAYMELRSLRAEDTAVYYCNAAYGSSSYPMDYWGQGTLVTVSS

SEQ ID NO: 117 - protein, 107 aa, Artificial Sequence; identical to SEQ ID NO: 89
  CG_122_VL

SEQ ID NO: 118 - protein, 120 aa, Artificial Sequence
  CG_122_VH
QMQLVQSGAEVKKPGSSVKVSCKASGFNIKDYYLHWVRQAPGKGLEWMGWIDPDQGLTEYAQKFQGRVTITRDRSTSTAYMELRSLRAEDTAVYYCNAAYDSSSYPMDYWGQGTLVTVSS

SEQ ID NO: 119 - protein, 107 aa, Artificial Sequence; identical to SEQ ID NO: 89
  CG_123_VL

SEQ ID NO: 120 - protein, 120 aa, Artificial Sequence
  CG_123_VH
QMQLVQSGAEVKKPGSSVKVSCKASGFNIKDYYLHWVRQAPGKGLEWMGWIDPDVGDTEYAQKFQGRVTITRDRSTSTAYMELRSLRAEDTAVYYCNAAYGVSSYPMDYWGQGTLVTVSS

SEQ ID NO: 121 - protein, 107 aa, Artificial Sequence; identical to SEQ ID NO: 89
  CG_124_VL

SEQ ID NO: 122 - protein, 120 aa, Artificial Sequence
  CG_124_VH
QMQLVQSGAEVKKPGSSVKVSCKASGFNIKDYYLHWVRQAPGKGLEWMGWIDPDQGTTYYAQKFQGRVTITRDRSTSTAYMELRSLRAEDTAVYYCNAAYGSSSYPMDYWGQGTLVTVSS

SEQ ID NO: 123 - protein, 107 aa, Artificial Sequence; identical to SEQ ID NO: 89
  CG_125_VL

SEQ ID NO: 124 - protein, 120 aa, Artificial Sequence
  CG_125_VH
QMQLVQSGAEVKKPGSSVKVSCKASGFNIKDYYLHWVRQAPGKGLEWMGWIDPDQGDTLYAQKFQGRVTITRDRSTSTAYMELRSLRAEDTAVYYCNAAYGDSSYPMDYWGQGTLVTVSS

SEQ ID NO: 125 - protein, 107 aa, Artificial Sequence; identical to SEQ ID NO: 89
  CG_126_VL

SEQ ID NO: 126 - protein, 120 aa, Artificial Sequence
  CG_126_VH
QMQLVQSGAEVKKPGSSVKVSCKASGFNIKDYYLHWVRQAPGKGLEWMGWIDPDLGDTYYAQKFQGRVTITRDRSTSTAYMELRSLRAEDTAVYYCNAAYGSSSYPMDYWGQGTLVTVSS

SEQ ID NO: 127 - protein, 107 aa, Artificial Sequence; identical to SEQ ID NO: 89
  CG_127_VL

SEQ ID NO: 128 - protein, 120 aa, Artificial Sequence
  CG_127_VH
QMQLVQSGAEVKKPGSSVKVSCKASGFNIKVYYLHWVRQAPGKGLEWMGWIDPDQGDTEYAQKFQGRVTITRDRSTSTAYMELRSLRAEDTAVYYCNAAYGYSSYPMDYWGQGTLVTVSS

SEQ ID NO: 129 - protein, 107 aa, Artificial Sequence; identical to SEQ ID NO: 89
  CG_128_VL

SEQ ID NO: 130 - protein, 120 aa, Artificial Sequence
  CG_128_VH
QMQLVQSGAEVKKPGSSVKVSCKASGFNIKDYYLHWVRQAPGKGLEWMGWIDPDQGHTEYAQKFQGRVTITRDRSTSTAYMELRSLRAEDTAVYYCNAAYYSSSYPMDYWGQGTLVTVSS

SEQ ID NO: 131 - protein, 107 aa, Artificial Sequence; identical to SEQ ID NO: 89
  CG_129_VL

SEQ ID NO: 132 - protein, 120 aa, Artificial Sequence
  CG_129_VH
QMQLVQSGAEVKKPGSSVKVSCKASGFNIKDYYLHWVRQAPGKGLEWMGWIDPDQGDTYYAQKFQGRVTITRDRSTSTAYMELRSLRAEDTAVYYCNAAYGYSSYPMDYWGQGTLVTVSS

SEQ ID NO: 133 - protein, 107 aa, Artificial Sequence; identical to SEQ ID NO: 89
  CG_130_VL

SEQ ID NO: 134 - protein, 120 aa, Artificial Sequence
  CG_130_VH
QMQLVQSGAEVKKPGSSVKVSCKASGFNIKDYYLHWVRQAPGKGLEWMGWIDPLVGDTEYAQKFQGRVTITRDRSTSTAYMELRSLRAEDTAVYYCNAAYGSSSYPMDYWGQGTLVTVSS

SEQ ID NO: 135 - protein, 107 aa, Artificial Sequence; identical to SEQ ID NO: 89
  CG_131_VL

SEQ ID NO: 136 - protein, 120 aa, Artificial Sequence
  CG_131_VH
QMQLVQSGAEVKKPGSSVKVSCKASGFNIKDYVLHWVRQAPGKGLEWMGWIDPDLGDTEYAQKFQGRVTITRDRSTSTAYMELRSLRAEDTAVYYCNAAYGSSSYPMDYWGQGTLVTVSS

SEQ ID NO: 137 - protein, 107 aa, Artificial Sequence; identical to SEQ ID NO: 89
  CG_132_VL

SEQ ID NO: 138 - protein, 120 aa, Artificial Sequence
  CG_132_VH
QMQLVQSGAEVKKPGSSVKVSCKASGFNIKDYYLHWVRQAPGKGLEWMGWIDPDEGLTEYAQKFQGRVTITRDRSTSTAYMELRSLRAEDTAVYYCNAAYGSSSYPMDYWGQGTLVTVSS

SEQ ID NO: 139 - protein, 107 aa, Artificial Sequence; identical to SEQ ID NO: 89
  CG_133_VL

SEQ ID NO: 140 - protein, 120 aa, Artificial Sequence
  CG_133_VH
QMQLVQSGAEVKKPGSSVKVSCKASGFNIKDYYLHWVRQAPGKGLEWMGWIDPDQGDTYYAQKFQGRVTITRDRSTSTAYMELRSLRAEDTAVYYCNAAYGKSSYPMDYWGQGTLVTVSS

SEQ ID NO: 141 - protein, 107 aa, Artificial Sequence; identical to SEQ ID NO: 89
  CG_134_VL

SEQ ID NO: 142 - protein, 120 aa, Artificial Sequence
  CG_134_VH
QMQLVQSGAEVKKPGSSVKVSCKASGFNIKDYYLHWVRQAPGKGLEWMGWILPDQGDSEYAQKFQGRVTITRDRSTSTAYMELRSLRAEDTAVYYCNAAYGSSSYPMDYWGQGTLVTVSS

SEQ ID NO: 143 - protein, 107 aa, Artificial Sequence; identical to SEQ ID NO: 89
  CG_135_VL

SEQ ID NO: 144 - protein, 120 aa, Artificial Sequence
  CG_135_VH
QMQLVQSGAEVKKPGSSVKVSCKASGFNIKDYYLHWVRQAPGKGLEWMGWIQPDQGDTAYAQKFQGRVTITRDRSTSTAYMELRSLRAEDTAVYYCNAAYGSSSYPMDYWGQGTLVTVSS

SEQ ID NO: 145 - protein, 107 aa, Artificial Sequence; identical to SEQ ID NO: 89
  CG_136_VL

SEQ ID NO: 146 - protein, 120 aa, Artificial Sequence
  CG_136_VH
QMQLVQSGAEVKKPGSSVKVSCKASGFNIKDYYLHWVRQAPGKGLEWMGWILPDVGDTEYAQKFQGRVTITRDRSTSTAYMELRSLRAEDTAVYYCNAAYGSSSYPMDYWGQGTLVTVSS

SEQ ID NO: 147 - protein, 107 aa, Artificial Sequence; identical to SEQ ID NO: 89
  CG_137_VL

SEQ ID NO: 148 - protein, 120 aa, Artificial Sequence
  CG_137_VH
QMQLVQSGAEVKKPGSSVKVSCKASGFNIKEYYLHWVRQAPGKGLEWMGWIDPDTGDTEYAQKFQGRVTITRDRSTSTAYMELRSLRAEDTAVYYCNAAYGSSSYPMDYWGQGTLVTVSS

SEQ ID NO: 149 - protein, 107 aa, Artificial Sequence; identical to SEQ ID NO: 89
  CG_138_VL

SEQ ID NO: 150 - protein, 120 aa, Artificial Sequence
  CG_138_VH
QMQLVQSGAEVKKPGSSVKVSCKASGFNIKDYYLHWVRQAPGKGLEWMGWILPDGGDTEYAQKFQGRVTITRDRSTSTAYMELRSLRAEDTAVYYCNAAYGSSSYPMDYWGQGTLVTVSS

SEQ ID NO: 151 - protein, 107 aa, Artificial Sequence; identical to SEQ ID NO: 89
  CG_139_VL

SEQ ID NO: 152 - protein, 120 aa, Artificial Sequence
  CG_139_VH
QMQLVQSGAEVKKPGSSVKVSCKASGFNIKDYYLHWVRQAPGKGLEWMGWIDPDQGDTYYAQKFQGRVTITRDRSTSTAYMELRSLRAEDTAVYYCNAAYGESSYPMDYWGQGTLVTVSS

SEQ ID NO: 153 - protein, 107 aa, Artificial Sequence; identical to SEQ ID NO: 89
  CG_140_VL

SEQ ID NO: 154 - protein, 120 aa, Artificial Sequence
  CG_140_VH
QMQLVQSGAEVKKPGSSVKVSCKASGFNIKDYYLHWVRQAPGKGLEWMGWIDPDQGDTYYAQKFQGRVTITRDRSTSTAYMELRSLRAEDTAVYYCNAAYGVSSYPMDYWGQGTLVTVSS

SEQ ID NO: 155 - protein, 107 aa, Artificial Sequence; identical to SEQ ID NO: 89
  CG_141_VL

SEQ ID NO: 156 - protein, 120 aa, Artificial Sequence
  CG_141_VH
QMQLVQSGAEVKKPGSSVKVSCKASGFNIKDYYLHWVRQAPGKGLEWMGWIDPDQGDTEYAQKFQGRVTITRDRSTSTAYMELRSLRAEDTAVYYCNAAYYYSSYPMDYWGQGTLVTVSS

SEQ ID NO: 157 - protein, 107 aa, Artificial Sequence
  CG_142_VL
NIQMTQSPSSLSASVGDRVTITCRASQDIHRYLSWFQQKPGKVPKHLIYRANYLVSGVPSRFSGSGSGTEFTLTISSLQPEDFATYYCLQYDQFPYTFGGGTKVEIK

SEQ ID NO: 158 - protein, 120 aa, Artificial Sequence
  CG_142_VH
QMQLVQSGAEVKKPGSSVKVSCKASGFNIKDYYLHWVRQAPGKGLEWMGWIDPDQGDTEYAQKFQGRVTITRDRSTSTAYMELRSLRAEDTAVYYCNAAYGSSSYPMDYWGQGTLVTVSS

SEQ ID NO: 159 - protein, 107 aa, Artificial Sequence
  CG_143_VL
NIQMTQSPSSLSASVGDRVTITCRASQDIQRYLSWFQQKPGKVPKHLIYYANRLVSGVPSRFSGSGSGTEFTLTISSLQPEDFATYYCLQYDEFPYTFGGGTKVEIK

SEQ ID NO: 160 - protein, 120 aa, Artificial Sequence; identical to SEQ ID NO: 158
  CG_143_VH

SEQ ID NO: 161 - protein, 107 aa, Artificial Sequence
  CG_144_VL
NIQMTQSPSSLSASVGDRVTITCRASQDISRYLSWFQQKPGKVPKHLIYYANRLVSGVPSRFSGSGSGTEFTLTISSLQPEDFATYYCLQYDEFPYTFGGGTKVEIK

SEQ ID NO: 162 - protein, 120 aa, Artificial Sequence; identical to SEQ ID NO: 158
  CG_144_VH

SEQ ID NO: 163 - protein, 107 aa, Artificial Sequence
  CG_145_VL
NIQMTQSPSSLSASVGDRVTITCRASQDIHRYLSWFQQKPGKVPKHLIYRANYLVSGVPSRFSGSGSGTEFTLTISSLQPEDFATYYCLQYDHFPYTFGGGTKVEIK

SEQ ID NO: 164 - protein, 120 aa, Artificial Sequence; identical to SEQ ID NO: 158
  CG_145_VH

SEQ ID NO: 165 - protein, 107 aa, Artificial Sequence
  CG_146_VL
NIQMTQSPSSLSASVGDRVTITCRASQDIHRYLSWFQQKPGKVPKHLIYYANRLVSGVPSRFSGSGSGTEFTLTISSLQPEDFATYYCLQYYEFPYTFGGGTKVEIK

SEQ ID NO: 166 - protein, 120 aa, Artificial Sequence; identical to SEQ ID NO: 158
  CG_146_VH

SEQ ID NO: 167 - protein, 107 aa, Artificial Sequence
  CG_147_VL
NIQMTQSPSSLSASVGDRVTITCRASQDIARYLSWFQQKPGKVPKHLIYRANRLVSGVPSRFSGSGSGTEFTLTISSLQPEDFATYYCLQYDVFPYTFGGGTKVEIK

SEQ ID NO: 168 - protein, 120 aa, Artificial Sequence; identical to SEQ ID NO: 158
  CG_147_VH

SEQ ID NO: 169 - protein, 107 aa, Artificial Sequence
  CG_148_VL
NIQMTQSPSSLSASVGDRVTITCRASQDIHRYLSWFQQKPGKVPKHLIYRANYLVSGVPSRFSGSGSGTEFTLTISSLQPEDFATYYCLQYDLFPYTFGGGTKVEIK

SEQ ID NO: 170 - protein, 120 aa, Artificial Sequence; identical to SEQ ID NO: 158
  CG_148_VH

SEQ ID NO: 171 - protein, 107 aa, Artificial Sequence
  CG_149_VL
NIQMTQSPSSLSASVGDRVTITCRASQDIHRYLSWFQQKPGKVPKHLIYRANYLVSGVPSRFSGSGSGTEFTLTISSLQPEDFATYYCLQYQEFPYTFGGGTKVEIK

SEQ ID NO: 172 - protein, 120 aa, Artificial Sequence; identical to SEQ ID NO: 158
  CG_149_VH

SEQ ID NO: 173 - protein, 107 aa, Artificial Sequence
  CG_150_VL
NIQMTQSPSSLSASVGDRVTITCRASQDIYYYLSWFQQKPGKVPKHLIYRANRLVSGVPSRFSGSGSGTEFTLTISSLQPEDFATYYCLQYDEFPYTFGGGTKVEIK

SEQ ID NO: 174 - protein, 120 aa, Artificial Sequence; identical to SEQ ID NO: 158
  CG_150_VH

SEQ ID NO: 175 - protein, 107 aa, Artificial Sequence
  CG_151_VL
NIQMTQSPSSLSASVGDRVTITCRASQDIHRYLSWFQQKPGKVPKHLIYRANYLVSGVPSRFSGSGSGTEFTLTISSLQPEDFATYYCLQYVEFPYTFGGGTKVEIK

SEQ ID NO: 176 - protein, 120 aa, Artificial Sequence; identical to SEQ ID NO: 158
  CG_151_VH

SEQ ID NO: 177 - protein, 107 aa, Artificial Sequence
  CG_152_VL
NIQMTQSPSSLSASVGDRVTITCRASQDIHRYLSWFQQKPGKVPKHLIYYANRLVSGVPSRFSGSGSGTEFTLTISSLQPEDFATYYCLQYHEFPYTFGGGTKVEIK

SEQ ID NO: 178 - protein, 120 aa, Artificial Sequence; identical to SEQ ID NO: 158
  CG_152_VH

SEQ ID NO: 179 - protein, 107 aa, Artificial Sequence
  CG_153_VL
NIQMTQSPSSLSASVGDRVTITCRASQDIERYLSWFQQKPGKVPKHLIYYANRLVSGVPSRFSGSGSGTEFTLTISSLQPEDFATYYCLQYDEFPYTFGGGTKVEIK

SEQ ID NO: 180 - protein, 120 aa, Artificial Sequence; identical to SEQ ID NO: 158
  CG_153_VH

SEQ ID NO: 181 - protein, 107 aa, Artificial Sequence
  CG_154_VL
NIQMTQSPSSLSASVGDRVTITCRASQDIHRYLSWFQQKPGKVPKHLIYRANYLVSGVPSRFSGSGSGTEFTLTISSLQPEDFATYYCLQYDKFPYTFGGGTKVEIK

SEQ ID NO: 182 - protein, 120 aa, Artificial Sequence; identical to SEQ ID NO: 158
  CG_154_VH

SEQ ID NO: 183 - protein, 107 aa, Artificial Sequence
  CG_155_VL
NIQMTQSPSSLSASVGDRVTITCRASQDIYTYLSWFQQKPGKVPKHLIYRANRLVSGVPSRFSGSGSGTEFTLTISSLQPEDFATYYCLQYDEFPYTFGGGTKVEIK

SEQ ID NO: 184 - protein, 120 aa, Artificial Sequence; identical to SEQ ID NO: 158
  CG_155_VH

SEQ ID NO: 185 - protein, 107 aa, Artificial Sequence
  CG_156_VL
NIQMTQSPSSLSASVGDRVTITCRASQDILRYLSWFQQKPGKVPKHLIYYANRLVSGVPSRFSGSGSGTEFTLTISSLQPEDFATYYCLQYDEFPYTFGGGTKVEIK

SEQ ID NO: 186 - protein, 120 aa, Artificial Sequence; identical to SEQ ID NO: 158
  CG_156_VH

SEQ ID NO: 187 - protein, 107 aa, Artificial Sequence
  CG_157_VL
NIQMTQSPSSLSASVGDRVTITCRASQDITRYLSWFQQKPGKVPKHLIYYANRLVSGVPSRFSGSGSGTEFTLTISSLQPEDFATYYCLQYDEFPYTFGGGTKVEIK

SEQ ID NO: 188 - protein, 120 aa, Artificial Sequence; identical to SEQ ID NO: 158
  CG_157_VH

SEQ ID NO: 189 - protein, 107 aa, Artificial Sequence
  CG_158_VL
NIQMTQSPSSLSASVGDRVTITCRASQDIDRYLSWFQQKPGKVPKHLIYRANRLVSGVPSRFSGSGSGTEFTLTISSLQPEDFATYYCLQYDLFPYTFGGGTKVEIK

SEQ ID NO: 190 - protein, 120 aa, Artificial Sequence; identical to SEQ ID NO: 158
  CG_158_VH

SEQ ID NO: 191 - protein, 107 aa, Artificial Sequence
  CG_159_VL
NIQMTQSPSSLSASVGDRVTITCRASQDIHVYLSWFQQKPGKVPKHLIYRANRLVSGVPSRFSGSGSGTEFTLTISSLQPEDFATYYCLQYYEFPYTFGGGTKVEIK

SEQ ID NO: 192 - protein, 120 aa, Artificial Sequence; identical to SEQ ID NO: 158
  CG_159_VH

SEQ ID NO: 193 - protein, 107 aa, Artificial Sequence
  CG_160_VL
NIQMTQSPSSLSASVGDRVTITCRASQDIHRYLSWFQQKPGKVPKHLIYRANYLVSGVPSRFSGSGSGTEFTLTISSLQPEDFATYYCLQYAEFPYTFGGGTKVEIK

SEQ ID NO: 194 - protein, 120 aa, Artificial Sequence; identical to SEQ ID NO: 158
  CG_160_VH

SEQ ID NO: 195 - protein, 107 aa, Artificial Sequence
  CG_161_VL
NIQMTQSPSSLSASVGDRVTITCRASQDILTYLSWFQQKPGKVPKHLIYRANRLVSGVPSRFSGSGSGTEFTLTISSLQPEDFATYYCLQYDEFPYTFGGGTKVEIK

SEQ ID NO: 196 - protein, 120 aa, Artificial Sequence; identical to SEQ ID NO: 158
  CG_161_VH

SEQ ID NO: 197 - protein, 107 aa, Artificial Sequence
  CG_162_VL
NIQMTQSPSSLSASVGDRVTITCRASQDIARYLSWFQQKPGKVPKHLIYYANRLVSGVPSRFSGSGSGTEFTLTISSLQPEDFATYYCLQYDEFPYTFGGGTKVEIK

SEQ ID NO: 198 - protein, 120 aa, Artificial Sequence; identical to SEQ ID NO: 158
  CG_162_VH

SEQ ID NO: 199 - protein, 107 aa, Artificial Sequence
  CG_163_VL
NIQMTQSPSSLSASVGDRVTITCRASQDIVTYLSWFQQKPGKVPKHLIYRANRLVSGVPSRFSGSGSGTEFTLTISSLQPEDFATYYCLQYDEFPYTFGGGTKVEIK

SEQ ID NO: 200 - protein, 120 aa, Artificial Sequence; identical to SEQ ID NO: 158
  CG_163_VH

SEQ ID NO: 201 - protein, 107 aa, Artificial Sequence
  CG_164_VL
NIQMTQSPSSLSASVGDRVTITCRASQDILEYLSWFQQKPGKVPKHLIYRANRLVSGVPSRFSGSGSGTEFTLTISSLQPEDFATYYCLQYDEFPYTFGGGTKVEIK

SEQ ID NO: 202 - protein, 120 aa, Artificial Sequence; identical to SEQ ID NO: 158
  CG_164_VH

SEQ ID NO: 203 - protein, 107 aa, Artificial Sequence
  CG_165_VL
NIQMTQSPSSLSASVGDRVTITCRASQDIHRYLSWFQQKPGKVPKHLIYRANYLVSGVPSRFSGSGSGTEFTLTISSLQPEDFATYYCLQYYEFPYTFGGGTKVEIK

SEQ ID NO: 204 - protein, 120 aa, Artificial Sequence; identical to SEQ ID NO: 158
  CG_165_VH

SEQ ID NO: 205 - protein, 107 aa, Artificial Sequence
  CG_166_VL
NIQMTQSPSSLSASVGDRVTITCRASQDIHRYLSWFQQKPGKVPKHLIYYANRLVSGVPSRFSGSGSGTEFTLTISSLQPEDFATYYCLQYDVFPYTFGGGTKVEIK

SEQ ID NO: 206 - protein, 120 aa, Artificial Sequence; identical to SEQ ID NO: 158
  CG_166_VH

SEQ ID NO: 207 - protein, 107 aa, Artificial Sequence
  CG_167_VL
NIQMTQSPSSLSASVGDRVTITCRASQDILVYLSWFQQKPGKVPKHLIYRANRLVSGVPSRFSGSGSGTEFTLTISSLQPEDFATYYCLQYDEFPYTFGGGTKVEIK

SEQ ID NO: 208 - protein, 120 aa, Artificial Sequence; identical to SEQ ID NO: 158
  CG_167_VH

SEQ ID NO: 209 - protein, 107 aa, Artificial Sequence; identical to SEQ ID NO: 1
  CG_168_VL

SEQ ID NO: 210 - protein, 120 aa, Artificial Sequence; identical to SEQ ID NO: 158
  CG_168_VH

SEQ ID NO: 211 - protein, 107 aa, Artificial Sequence; identical to SEQ ID NO: 3
  CG_169_VL

SEQ ID NO: 212 - protein, 120 aa, Artificial Sequence; identical to SEQ ID NO: 158
  CG_169_VH

SEQ ID NO: 213 - protein, 107 aa, Artificial Sequence; identical to SEQ ID NO: 5
  CG_170_VL

SEQ ID NO: 214 - protein, 120 aa, Artificial Sequence; identical to SEQ ID NO: 158
  CG_170_VH

SEQ ID NO: 215 - protein, 107 aa, Artificial Sequence; identical to SEQ ID NO: 7
  CG_171_VL

SEQ ID NO: 216 - protein, 120 aa, Artificial Sequence; identical to SEQ ID NO: 158
  CG_171_VH

SEQ ID NO: 217 - protein, 107 aa, Artificial Sequence; identical to SEQ ID NO: 9
  CG_172_VL

SEQ ID NO: 218 - protein, 120 aa, Artificial Sequence; identical to SEQ ID NO: 158
  CG_172_VH

SEQ ID NO: 219 - protein, 107 aa, Artificial Sequence; identical to SEQ ID NO: 11
  CG_173_VL

SEQ ID NO: 220 - protein, 120 aa, Artificial Sequence; identical to SEQ ID NO: 158
  CG_173_VH

SEQ ID NO: 221 - protein, 107 aa, Artificial Sequence; identical to SEQ ID NO: 13
  CG_174_VL

SEQ ID NO: 222 - protein, 120 aa, Artificial Sequence; identical to SEQ ID NO: 158
  CG_174_VH

SEQ ID NO: 223 - protein, 107 aa, Artificial Sequence; identical to SEQ ID NO: 15
  CG_175_VL

SEQ ID NO: 224 - protein, 120 aa, Artificial Sequence; identical to SEQ ID NO: 158
  CG_175_VH

SEQ ID NO: 225 - protein, 107 aa, Artificial Sequence; identical to SEQ ID NO: 17
  CG_176_VL

SEQ ID NO: 226 - protein, 120 aa, Artificial Sequence; identical to SEQ ID NO: 158
  CG_176_VH

SEQ ID NO: 227 - protein, 107 aa, Artificial Sequence; identical to SEQ ID NO: 19
  CG_177_VL

SEQ ID NO: 228 - protein, 120 aa, Artificial Sequence; identical to SEQ ID NO: 158
  CG_177_VH

SEQ ID NO: 229 - protein, 107 aa, Artificial Sequence; identical to SEQ ID NO: 21
  CG_178_VL

SEQ ID NO: 230 - protein, 120 aa, Artificial Sequence; identical to SEQ ID NO: 158
  CG_178_VH

SEQ ID NO: 231 - protein, 107 aa, Artificial Sequence; identical to SEQ ID NO: 25
  CG_179_VL

SEQ ID NO: 232 - protein, 120 aa, Artificial Sequence; identical to SEQ ID NO: 158
  CG_179_VH

SEQ ID NO: 233 - protein, 107 aa, Artificial Sequence; identical to SEQ ID NO: 27
  CG_180_VL

SEQ ID NO: 234 - protein, 120 aa, Artificial Sequence; identical to SEQ ID NO: 158
  CG_180_VH

SEQ ID NO: 235 - protein, 107 aa, Artificial Sequence; identical to SEQ ID NO: 29
  CG_181_VL

SEQ ID NO: 236 - protein, 120 aa, Artificial Sequence; identical to SEQ ID NO: 158
  CG_181_VH

SEQ ID NO: 237 - protein, 107 aa, Artificial Sequence; identical to SEQ ID NO: 31
  CG_182_VL

SEQ ID NO: 238 - protein, 120 aa, Artificial Sequence; identical to SEQ ID NO: 158
  CG_182_VH

SEQ ID NO: 239 - protein, 107 aa, Artificial Sequence; identical to SEQ ID NO: 33
  CG_183_VL

SEQ ID NO: 240 - protein, 120 aa, Artificial Sequence; identical to SEQ ID NO: 158
  CG_183_VH

SEQ ID NO: 241 - protein, 107 aa, Artificial Sequence; identical to SEQ ID NO: 35
  CG_184_VL

SEQ ID NO: 242 - protein, 120 aa, Artificial Sequence; identical to SEQ ID NO: 158
  CG_184_VH

SEQ ID NO: 243 - protein, 107 aa, Artificial Sequence; identical to SEQ ID NO: 37
  CG_185_VL

SEQ ID NO: 244 - protein, 120 aa, Artificial Sequence; identical to SEQ ID NO: 158
  CG_185_VH

SEQ ID NO: 245 - protein, 107 aa, Artificial Sequence; identical to SEQ ID NO: 49
  CG_186_VL

SEQ ID NO: 246 - protein, 120 aa, Artificial Sequence; identical to SEQ ID NO: 158
  CG_186_VH

SEQ ID NO: 247 - protein, 107 aa, Artificial Sequence; identical to SEQ ID NO: 43
  CG_187_VL

SEQ ID NO: 248 - protein, 120 aa, Artificial Sequence; identical to SEQ ID NO: 158
  CG_187_VH

SEQ ID NO: 249 - protein, 107 aa, Artificial Sequence; identical to SEQ ID NO: 23
  CG_188_VL

SEQ ID NO: 250 - protein, 120 aa, Artificial Sequence; identical to SEQ ID NO: 158
  CG_188_VH

SEQ ID NO: 251 - protein, 107 aa, Artificial Sequence; identical to SEQ ID NO: 55
  CG_189_VL

SEQ ID NO: 252 - protein, 120 aa, Artificial Sequence; identical to SEQ ID NO: 158
  CG_189_VH

SEQ ID NO: 253 - protein, 107 aa, Artificial Sequence; identical to SEQ ID NO: 57
  CG_190_VL

SEQ ID NO: 254 - protein, 120 aa, Artificial Sequence; identical to SEQ ID NO: 158
  CG_190_VH

SEQ ID NO: 255 - protein, 107 aa, Artificial Sequence; identical to SEQ ID NO: 59
  CG_191_VL

SEQ ID NO: 256 - protein, 120 aa, Artificial Sequence; identical to SEQ ID NO: 158
  CG_191_VH

SEQ ID NO: 257 - protein, 107 aa, Artificial Sequence; identical to SEQ ID NO: 65
  CG_192_VL

SEQ ID NO: 258 - protein, 120 aa, Artificial Sequence; identical to SEQ ID NO: 158
  CG_192_VH

SEQ ID NO: 259 - protein, 107 aa, Artificial Sequence; identical to SEQ ID NO: 67
  CG_193_VL

SEQ ID NO: 260 - protein, 120 aa, Artificial Sequence; identical to SEQ ID NO: 158
  CG_193_VH

SEQ ID NO: 261 - protein, 107 aa, Artificial Sequence; identical to SEQ ID NO: 69
  CG_194_VL

SEQ ID NO: 262 - protein, 120 aa, Artificial Sequence; identical to SEQ ID NO: 158
  CG_194_VH

SEQ ID NO: 263 - protein, 107 aa, Artificial Sequence; identical to SEQ ID NO: 25
  CG_195_VL

SEQ ID NO: 264 - protein, 120 aa, Artificial Sequence; identical to SEQ ID NO: 158
  CG_195_VH

SEQ ID NO: 265 - protein, 107 aa, Artificial Sequence; identical to SEQ ID NO: 47
  CG_196_VL

SEQ ID NO: 266 - protein, 120 aa, Artificial Sequence; identical to SEQ ID NO: 158
  CG_196_VH

SEQ ID NO: 267 - protein, 107 aa, Artificial Sequence; identical to SEQ ID NO: 45
  CG_197_VL

SEQ ID NO: 268 - protein, 120 aa, Artificial Sequence; identical to SEQ ID NO: 158
  CG_197_VH

SEQ ID NO: 269 - protein, 107 aa, Artificial Sequence; identical to SEQ ID NO: 79
  CG_198_VL

SEQ ID NO: 270 - protein, 120 aa, Artificial Sequence; identical to SEQ ID NO: 158
  CG_198_VH

SEQ ID NO: 271 - protein, 107 aa, Artificial Sequence; identical to SEQ ID NO: 87
  CG_199_VL

SEQ ID NO: 272 - protein, 120 aa, Artificial Sequence; identical to SEQ ID NO: 158
  CG_199_VH

SEQ ID NO: 273 - protein, 107 aa, Artificial Sequence; identical to SEQ ID NO: 89
  CG_200_VL

SEQ ID NO: 274 - protein, 120 aa, Artificial Sequence; identical to SEQ ID NO: 158
  CG_200_VH

SEQ ID NO: 275 - protein, 107 aa, Artificial Sequence
  CG_201_VL
NIQMTQSPSSLSASVGDRVTITCRASQDIHRYLSWFQQKPGKVPKHLIYRESRFVDGVPSRFSGSGSGTEFTLTISSLQPEDFATYYCLQYDEFPYTFGGGTKVEIK

SEQ ID NO: 276 - protein, 120 aa, Artificial Sequence; identical to SEQ ID NO: 152
  CG_201_VH

SEQ ID NO: 277 - protein, 107 aa, Artificial Sequence
  CG_202_VL
NIQMTQSPSSLSASVGDRVTITCQASQDIHRYLSWFQQDPGTVPQHLIYRESRFVDGVPSRFSGSGSGTEFTLTISSLQPEDFATYYCLQYDEFPYTFGGGTKVEIK

SEQ ID NO: 278 - protein, 120 aa, Artificial Sequence
  CG_202_VH
QMQLVQSGAEVKKPGSSVKVSCKASGFNIKDYYLHWVRQAPGQGLEWMGWIDPDQGDTYYAQKFQGRVTITRDRSTSTAYMELASLTAEDTAVYYCNAAYGESSYPMDYWGQGTLVTVSS

SEQ ID NO: 279 - protein, 107 aa, Artificial Sequence; identical to SEQ ID NO: 89
  CG_203_VL

SEQ ID NO: 280 - protein, 120 aa, Artificial Sequence; identical to SEQ ID NO: 152
  CG_203_VH

SEQ ID NO: 281 - protein, 107 aa, Artificial Sequence; identical to SEQ ID NO: 277
  CG_204_VL

SEQ ID NO: 282 - protein, 120 aa, Artificial Sequence
  CG_204_VH
QMQLVQSGAEVKKPGSSVKVSCKASGFNIKDYYLHWVRQAPGQGLEWMGWIDPDQGDTYYAQKFQGRVTITRDRSTSTAYMELASLTAEDTAVYYCNAAYGDSSYPMDYWGQGTLVTVSS

SEQ ID NO: 283 - protein, 107 aa, Artificial Sequence; identical to SEQ ID NO: 275
  CG_205_VL

SEQ ID NO: 284 - protein, 120 aa, Artificial Sequence; identical to SEQ ID NO: 90
  CG_205_VH

SEQ ID NO: 285 - protein, 107 aa, Artificial Sequence; identical to SEQ ID NO: 277
  CG_206_VL

SEQ ID NO: 286 - protein, 120 aa, Artificial Sequence
  CG_206_VH
QMQLVQSGAEVKKPGSSVKVSCKASGFNIKDYYLHWVRQAPGQGLEWMGYIDPSQGDTVYAQKFQGRVTITRDRSTSTAYMELASLTAEDTAVYYCNAAYGSSSYPMDYWGQGTLVTVSS

SEQ ID NO: 287 - protein, 107 aa, Artificial Sequence
  CG_207_VL
NIQMTQSPSSLSASVGDRVTITCQASQDIHEYLSWFQQDPGTVPQHLIYRESLFVDGVPSRFSGSGSGTEFTLTISSLQPEDFATYYCLQYDEFPYTFGGGTKVEIK

SEQ ID NO: 288 - protein, 120 aa, Artificial Sequence
  CG_207_VH
QMQLVQSGAEVKKPGSSVKVSCKASGFNIKDYYLHWVRQAPGQGLEWMGWIDPDQGDTEYAQKFQGRVTITRDRSTSTAYMELASLTAEDTAVYYCNAAYGSSSYPMDYWGQGTLVTVSS

SEQ ID NO: 289 - protein, 107 aa, Artificial Sequence; identical to SEQ ID NO: 277
  CG_208_VL

SEQ ID NO: 290 - protein, 120 aa, Artificial Sequence
  CG_208_VH
QMQLVQSGAEVKKPGSSVKVSCKASGFNIKDYYLHWVRQAPGQGLEWMGWIDPDQGDTAYAQKFQGRVTITRDRSTSTAYMELASLTAEDTAVYYCNAAYGLSSYPMDYWGQGTLVTVSS

SEQ ID NO: 291 - protein, 107 aa, Artificial Sequence; identical to SEQ ID NO: 277
  CG_209_VL

SEQ ID NO: 292 - protein, 120 aa, Artificial Sequence
  CG_209_VH
QMQLVQSGAEVKKPGSSVKVSCKASGFNIKDYYLHWVRQAPGQGLEWMGWIDPDQGATYYAQKFQGRVTITRDRSTSTAYMELASLTAEDTAVYYCNAAYGSSSYPMDYWGQGTLVTVSS

SEQ ID NO: 293 - protein, 107 aa, Artificial Sequence; identical to SEQ ID NO: 277
  CG_210_VL

SEQ ID NO: 294 - protein, 120 aa, Artificial Sequence
  CG_210_VH
QMQLVQSGAEVKKPGSSVKVSCKASGFNIKDYYLHWVRQAPGQGLEWMGWIDPDVGSTEYAQKFQGRVTITRDRSTSTAYMELASLTAEDTAVYYCNAAYGSSSYPMDYWGQGTLVTVSS

SEQ ID NO: 295 - protein, 107 aa, Artificial Sequence; identical to SEQ ID NO: 277
  CG_211_VL

SEQ ID NO: 296 - protein, 120 aa, Artificial Sequence; identical to SEQ ID NO: 288
  CG_211_VH

SEQ ID NO: 297 - protein, 107 aa, Artificial Sequence
  CG_212_VL
NIQMTQSPSSLSASVGDRVTITCRASQDIHRYLSWFQQKPGKVPKHLIYRESRFVDGVPSRFSGSGSGTEFTLTISSLQPEDFATYYCLQYEEFPYTFGGGTKVEIK

SEQ ID NO: 298 - protein, 120 aa, Artificial Sequence
  CG_212_VH
QMQLVQSGAEVKKPGSSVKVSCKASGFNIKDYYLHWVRQAPGKGLEWMGWIDPDQGLTEYAQKFQGRVTITRDRSTSTAYMELRSLRAEDTAVYYCNAAYGSSSYPMDYWGQGTLVTVSS

SEQ ID NO: 299 - protein, 107 aa, Artificial Sequence
  CG_213_VL
NIQMTQSPSSLSASVGDRVTITCQASQDIHRYLSWFQQDPGTVPQHLIYRESRFVDGVPSRFSGSGSGTEFTLTISSLQPEDFATYYCLQYEEFPYTFGGGTKVEIK

SEQ ID NO: 300 - protein, 120 aa, Artificial Sequence; identical to SEQ ID NO: 288
  CG_213_VH

SEQ ID NO: 301 - protein, 107 aa, Artificial Sequence
  CG_214_VL
NIQMTQSPSSLSASVGDRVTITCRASQDIHRYLSWFQQKPGKVPKHLIYRESRFVDGVPSRFSGSGSGTEFTLTISSLQPEDFATYYCLQYAEFPYTFGGGTKVEIK

SEQ ID NO: 302 - protein, 120 aa, Artificial Sequence; identical to SEQ ID NO: 298
  CG_214_VH

SEQ ID NO: 303 - protein, 107 aa, Artificial Sequence
  CG_215_VL
NIQMTQSPSSLSASVGDRVTITCQASQDIHRYLSWFQQDPGTVPQHLIYRESRFVDGVPSRFSGSGSGTEFTLTISSLQPEDFATYYCLQYAEFPYTFGGGTKVEIK

SEQ ID NO: 304 - protein, 120 aa, Artificial Sequence; identical to SEQ ID NO: 288
  CG_215_VH

SEQ ID NO: 305 - protein, 107 aa, Artificial Sequence; identical to SEQ ID NO: 1
  CG_216_VL

SEQ ID NO: 306 - protein, 120 aa, Artificial Sequence; identical to SEQ ID NO: 158
  CG_216_VH

SEQ ID NO: 307 - protein, 107 aa, Artificial Sequence; identical to SEQ ID NO: 275
  CG_217_VL

SEQ ID NO: 308 - protein, 120 aa, Artificial Sequence; identical to SEQ ID NO: 138
  CG_217_VH

SEQ ID NO: 309 - protein, 107 aa, Artificial Sequence; identical to SEQ ID NO: 277
  CG_218_VL

SEQ ID NO: 310 - protein, 120 aa, Artificial Sequence
  CG_218_VH
QMQLVQSGAEVKKPGSSVKVSCKASGFNIKDYYLHWVRQAPGQGLEWMGWIDPDEGLTEYAQKFQGRVTITRDRSTSTAYMELASLTAEDTAVYYCNAAYGSSSYPMDYWGQGTLVTVSS

SEQ ID NO: 311 - protein, 107 aa, Artificial Sequence; identical to SEQ ID NO: 277
  CG_219_VL

SEQ ID NO: 312 - protein, 120 aa, Artificial Sequence; identical to SEQ ID NO: 282
  CG_219_VH

SEQ ID NO: 313 - protein, 107 aa, Artificial Sequence; identical to SEQ ID NO: 277
  CG_220_VL

SEQ ID NO: 314 - protein, 120 aa, Artificial Sequence
  CG_220_VH
QMQLVQSGAEVKKPGSSVKVSCKASGFNIKDYYLHWVRQAPGQGLEWMGWIDPDQGDTVYAQKFQGRVTITRDRSTSTAYMELASLTAEDTAVYYCNAAYGESSYPMDYWGQGTLVTVSS

SEQ ID NO: 315 - protein, 107 aa, Artificial Sequence; identical to SEQ ID NO: 275
  CG_221_VL

SEQ ID NO: 316 - protein, 120 aa, Artificial Sequence; identical to SEQ ID NO: 90
  CG_221_VH

SEQ ID NO: 317 - protein, 107 aa, Artificial Sequence; identical to SEQ ID NO: 277
  1361 CD47 VL

SEQ ID NO: 318 - protein, 120 aa, Artificial Sequence; identical to SEQ ID NO: 278
  1361 CD47 VH

SEQ ID NO: 319 - protein, 107 aa, Artificial Sequence; identical to SEQ ID NO: 275
  1360 CD47 VL

SEQ ID NO: 320 - protein, 120 aa, Artificial Sequence; identical to SEQ ID NO: 152
  1360 CD47 VH

SEQ ID NO: 321 - protein, 107 aa, Artificial Sequence; identical to SEQ ID NO: 89
  1367 CD47 VL

SEQ ID NO: 322 - protein, 120 aa, Artificial Sequence; identical to SEQ ID NO: 152
  1367 CD47 VH

SEQ ID NO: 323 - protein, 106 aa, Artificial Sequence [sequence omitted]

SEQ ID NO: 324 - protein, 121 aa, Artificial Sequence [sequence omitted]

SEQ ID NO: 325 - protein, 107 aa, Artificial Sequence
  90002 VL
NIQMTQSPSAMSASVGDRVTITCKASQDIHRYLSWFQQKPGKVPKHLIYRANRLVSGVPSRFSGSGSGTEFTLTISSLQPEDFATYYCLQYDEFPYTFGGGTKVEIK

SEQ ID NO: 326 - protein, 120 aa, Artificial Sequence
  90002 VH
QMQLVQSGAEVKKTGSSVKVSCKASGFNIKDYYLHWVRQAPGQALEWMGWIDPDQGDTEYAQKFQDRVTITRDRSMSTAYMELSSLRSEDTAMYYCNAAYGSSSYPMDYWGQGTTVTVSS

SEQ ID NO: 327 - protein, 214 aa, Artificial Sequence
  90002 WHOLE LC / IgG1
NIQMTQSPSAMSASVGDRVTITCKASQDIHRYLSWFQQKPGKVPKHLIYRANRLVSGVPSRFSGSGSGTEFTLTISSLQPEDFATYYCLQYDEFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 328 - protein, 450 aa, Artificial Sequence
  90002 WHOLE HC / IgG1
QMQLVQSGAEVKKTGSSVKVSCKASGFNIKDYYLHWVRQAPGQALEWMGWIDPDQGDTEYAQKFQDRVTITRDRSMSTAYMELSSLRSEDTAMYYCNAAYGSSSYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 329 - protein, 213 aa, Artificial Sequence
  LC - WHOLE RITUXIMAB
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 330 - protein, 451 aa, Artificial Sequence
  HC - WHOLE RITUXIMAB
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 331 - protein, 213 aa, Artificial Sequence
  CD20 WHOLE LC
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVAIFPPSDERLKSGTASVVCVLNNFYPREAKVQWKVDNALQSGNSQESVTEQDSKDSTYSLSSRLTLSKADYEKHKVYACEVTHQGLSSPVTKSFNRGEC

SEQ ID NO: 332 - protein, 451 aa, Artificial Sequence
  CD20 WHOLE HC
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAWLGCEVTDYFPEPVTVSWNSGALTSGVHTFPAVLESSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 333 - protein, 214 aa, Artificial Sequence
  1361 CD47 WHOLE LC
NIQMTQSPSSLSASVGDRVTITCQASQDIHRYLSWFQQDPGTVPQHLIYRESRFVDGVPSRFSGSGSGTEFTLTISSLQPEDFATYYCLQYDEFPYTFGGGTKVEIKRTVAAPSVFIFPPSDEELKSGTASVVCWLNNFYPREAKVQWKVDNALQSGNSEESVTEQDSKDSTYSLSSTLELSKADYEKHKVYACEVTHQGLSSPVTKSFNRGEC

SEQ ID NO: 334 - protein, 450 aa, Artificial Sequence
  1361 CD47 WHOLE HC
QMQLVQSGAEVKKPGSSVKVSCKASGFNIKDYYLHWVRQAPGQGLEWMGWIDPDQGDTYYAQKFQGRVTITRDRSTSTAYMELASLTAEDTAVYYCNAAYGESSYPMDYWGQGTLVTVSSASTKGPSVFPLAPSSKSTSGGTAALGCLVKDYFPEPVTVSWNSGALTSGVHTFPAVLKSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 335 - protein, 214 aa, Artificial Sequence
  1360 CD47 WHOLE LC
NIQMTQSPSSLSASVGDRVTITCRASQDIHRYLSWFQQKPGKVPKHLIYRESRFVDGVPSRFSGSGSGTEFTLTISSLQPEDFATYYCLQYDEFPYTFGGGTKVEIKRTVAAPSVFIFPPSDEELKSGTASVVCWLNNFYPREAKVQWKVDNALQSGNSEESVTEQDSKDSTYSLSSTLELSKADYEKHKVYACEVTHQGLSSPVTKSFNRGEC

SEQ ID NO: 336 - protein, 450 aa, Artificial Sequence
  1360 CD47 WHOLE HC
QMQLVQSGAEVKKPGSSVKVSCKASGFNIKDYYLHWVRQAPGKGLEWMGWIDPDQGDTYYAQKFQGRVTITRDRSTSTAYMELRSLRAEDTAVYYCNAAYGESSYPMDYWGQGTLVTVSSASTKGPSVFPLAPSSKSTSGGTAALGCLVKDYFPEPVTVSWNSGALTSGVHTFPAVLKSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 337 - protein, 214 aa, Artificial Sequence
  1367 CD47 WHOLE LC
NIQMTQSPSSLSASVGDRVTITCRASQDIHRYLSWFQQKPGKVPKHLIYRANRLVSGVPSRFSGSGSGTEFTLTISSLQPEDFATYYCLQYDEFPYTFGGGTKVEIKRTVAAPSVFIFPPSDEELKSGTASVVCWLNNFYPREAKVQWKVDNALQSGNSEESVTEQDSKDSTYSLSSTLELSKADYEKHKVYACEVTHQGLSSPVTKSFNRGEC

SEQ ID NO: 338 - protein, 450 aa, Artificial Sequence; identical to SEQ ID NO: 336
  1367 CD47 WHOLE HC

SEQ ID NO: 339 - protein, 107 aa, Artificial Sequence
  anti-CD47 IgG1 LC Constant Region
RTVAAPSVFIFPPSDEELKSGTASVVCWLNNFYPREAKVQWKVDNALQSGNSEESVTEQDSKDSTYSLSSTLELSKADYEKHKVYACEVTHQGLSSPVTKSFNRGEC

SEQ ID NO: 340 - protein, 57 aa, Artificial Sequence
  anti-CD47 IgG1 LC Constant Region portion
ELKSGTASVVCWLNNFYPREAKVQWKVDNALQSGNSEESVTEQDSKDSTYSLSSTLE

SEQ ID NO: 341 - protein, 330 aa, Artificial Sequence
  anti-CD47 IgG1 HC Constant Region
ASTKGPSVFPLAPSSKSTSGGTAALGCLVKDYFPEPVTVSWNSGALTSGVHTFPAVLKSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 342 - protein, 220 aa, Artificial Sequence
  anti-CD47 IgG1 HC Constant Region portion
KSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTW

SEQ ID NO: 343 - protein, 107 aa, Artificial Sequence
  anti-CD20 IgG1 LC Constant Region
RTVAAPSVAIFPPSDERLKSGTASVVCVLNNFYPREAKVQWKVDNALQSGNSQESVTEQDSKDSTYSLSSRLTLSKADYEKHKVYACEVTHQGLSSPVTKSFNRGEC

SEQ ID NO: 344 - protein, 63 aa, Artificial Sequence
  anti-CD20 IgG1 LC Constant Region portion
AIFPPSDERLKSGTASVVCVLNNFYPREAKVQWKVDNALQSGNSQESVTEQDSKDSTYSLSSR

SEQ ID NO: 345 - protein, 330 aa, Artificial Sequence
  anti-CD20 IgG1 HC Constant Region
ASTKGPSVFPLAPSSKSTSGGTAWLGCEVTDYFPEPVTVSWNSGALTSGVHTFPAVLESSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 346 - protein, 267 aa, Artificial Sequence
  Recombinant Sequence
WLGCEVTDYFPEPVTVSWNSGALTSGVHTFPAVLESSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALV

SEQ ID NO: 347 - protein, 11 aa, Artificial Sequence
  90002 VL CDR1
KASQDIHRYLS

SEQ ID NO: 348 - protein, 7 aa, Artificial Sequence
  90002 VL CDR2
RANRLVS

SEQ ID NO: 349 - protein, 9 aa, Artificial Sequence
  90002 VL CDR3
LQYDEFPYT

SEQ ID NO: 350 - protein, 5 aa, Artificial Sequence
  90002 VH CDR1
DYYLH

SEQ ID NO: 351 - protein, 17 aa, Artificial Sequence
  90002 VH CDR2
WIDPDQGDTEYAQKFQD

SEQ ID NO: 352 - protein, 12 aa, Artificial Sequence
  90002 VH CDR3
AAYGSSSYPMDY

SEQ ID NO: 353 - protein, 10 aa, Artificial Sequence
  Rituximab CD20 VL CDR1
RASSSVSYIH

SEQ ID NO: 354 - protein, 7 aa, Artificial Sequence
  Rituximab CD20 VL CDR2
ATSNLAS

SEQ ID NO: 355 - protein, 9 aa, Artificial Sequence
  Rituximab CD20 VL CDR3
QQWTSNPPT

SEQ ID NO: 356 - protein, 5 aa, Artificial Sequence
  Rituximab CD20 VH CDR1
SYNMH

SEQ ID NO: 357 - protein, 17 aa, Artificial Sequence
  Rituximab CD20 VH CDR2
AIYPGNGDTSYNQKFKG

SEQ ID NO: 358 - protein, 12 aa, Artificial Sequence
  Rituximab CD20 VH CDR3
STYYGGDWYFNV

SEQ ID NO: 359 - protein, 11 aa, Artificial Sequence
  1361 CD47 VL CDR1
QASQDIHRYLS

SEQ ID NO: 360 - protein, 7 aa, Artificial Sequence
  1361 CD47 VL CDR2
RESRFVD

SEQ ID NO: 361 - protein, 9 aa, Artificial Sequence
  1361 CD47 VL CDR3
LQYDEFPYT

SEQ ID NO: 362 - protein, 5 aa, Artificial Sequence
  1361 CD47 VH CDR1
DYYLH

SEQ ID NO: 363 - protein, 17 aa, Artificial Sequence
  1361 CD47 VH CDR2
WIDPDQGDTYYAQKFQG

SEQ ID NO: 364 - protein, 11 aa, Artificial Sequence
  1361 CD47 VH CDR3
AYGESSYPMDY

SEQ ID NO: 365 - protein, 11 aa, Artificial Sequence
  1360 CD47 VL CDR1
RASQDIHRYLS

SEQ ID NO: 366 - protein, 7 aa, Artificial Sequence
  1360 CD47 VL CDR2
RESRFVD

SEQ ID NO: 367 - protein, 9 aa, Artificial Sequence
  1360 CD47 VL CDR3
LQYDEFPYT

SEQ ID NO: 368 - protein, 5 aa, Artificial Sequence
  1360 CD47 VH CDR1
DYYLH

SEQ ID NO: 369 - protein, 17 aa, Artificial Sequence
  1360 CD47 VH CDR2
WIDPDQGDTYYAQKFQG

SEQ ID NO: 370 - protein, 11 aa, Artificial Sequence
  1360 CD47 VH CDR3
AYGESSYPMDY

SEQ ID NO: 371 - protein, 11 aa, Artificial Sequence
  1367 CD47 VL CDR1
RASQDIHRYLS

SEQ ID NO: 372 - protein, 7 aa, Artificial Sequence
  1367 CD47 VL CDR2
RANRLVS

SEQ ID NO: 373 - protein, 9 aa, Artificial Sequence
  1367 CD47 VL CDR3
LQYDEFPYT

SEQ ID NO: 374 - protein, 5 aa, Artificial Sequence
  1367 CD47 VH CDR1
DYYLH

SEQ ID NO: 375 - protein, 17 aa, Artificial Sequence
  1367 CD47 VH CDR2
WIDPDQGDTYYAQKFQG

SEQ ID NO: 376 - protein, 11 aa, Artificial Sequence
  1367 CD47 VH CDR3
AYGESSYPMDY

SEQ ID NO: 377 - protein, 11 aa, Artificial Sequence
  1362 CD47 VL CDR1
RASQGISSWLA

SEQ ID NO: 378 - protein, 7 aa, Artificial Sequence
  1362 CD47 VL CDR2
AASVLES

SEQ ID NO: 379 - protein, 9 aa, Artificial Sequence
  1362 CD47 VL CDR3
QQANSFPYT

SEQ ID NO: 380 - protein, 5 aa, Artificial Sequence
  1362 CD47 VH CDR1
NFVMS

SEQ ID NO: 381 - protein, 17 aa, Artificial Sequence
  1362 CD47 VH CDR2
TISGSGGSTYYADSVKG

SEQ ID NO: 382 - protein, 8 aa, Artificial Sequence
  1362 CD47 VH CDR3
HYILRYFD

SEQ ID NO: 383 - protein, 107 aa, Artificial Sequence
  1362 CD47 VL
DIQMTQSPSSVSASVGDRVTITCRASQGISSWLAWYQQKPGKAPKLLIYAASVLESGVPSRFSGSGSGTDFTLTISSLQPEDFATYYCQQANSFPYTFGQGTKLEIK

SEQ ID NO: 384 - protein, 117 aa, Artificial Sequence
  1362 CD47 VH
EVQLLESGGGLVQPGGSLRLSCAASGFTFPNFVMSWVRQAPGKGLEWVSTISGSGGSTYYADSVKGRFTISRDNSKNMLYLQMNSLRAEDTAVYYCAKHYILRYFDWLAGTLVTVSS

SEQ ID NO: 385 - protein, 214 aa, Artificial Sequence
  1362 CD47 WHOLE LC
DIQMTQSPSSVSASVGDRVTITCRASQGISSWLAWYQQKPGKAPKLLIYAASVLESGVPSRFSGSGSGTDFTLTISSLQPEDFATYYCQQANSFPYTFGQGTKLEIKRTVAAPSVFIFPPSDEELKSGTASVVCWLNNFYPREAKVQWKVDNALQSGNSEESVTEQDSKDSTYSLSSTLELSKADYEKHKVYACEVTHQGLSSPVTKSFNRGEC

SEQ ID NO: 386 - protein, 447 aa, Artificial Sequence
  1362 CD47 WHOLE HC
EVQLLESGGGLVQPGGSLRLSCAASGFTFPNFVMSWVRQAPGKGLEWVSTISGSGGSTYYADSVKGRFTISRDNSKNMLYLQMNSLRAEDTAVYYCAKHYILRYFDWLAGTLVTVSSASTKGPSVFPLAPSSKSTSGGTAALGCLVKDYFPEPVTVSWNSGALTSGVHTFPAVLKSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 387 - protein, 107 aa, Artificial Sequence
  CG_1_VL
DIQMTQSPSSVSASVGDRVTITCRASQGISSWLAWYQQKPGKAPKLLIYAASVLESGVPSRFSGSGSGTDFTLTISSLQPEDFATYYCQQANTFPYTFGQGTKLEIK

SEQ ID NO: 388 - protein, 117 aa, Artificial Sequence
  CG_1_VH
EVQLLESGGGLVQPGGSLRLSCAASGFTFPNFVMSWVRQAPGKGLEWVSTISGSGGSTYYADSVKGRFTISRDNSKNMLYLQMNSLRAEDTAVYYCAKHHILRYFDWLAGTLVTVSS

SEQ ID NO: 389 - protein, 107 aa, Artificial Sequence
  CG_2_VL
DIQMTQSPSSVSASVGDRVTITCRASQGISSWLAWYQQKPGKAPKLLIYAASVLESGVPSRFSGSGSGTDFTLTISSLQPEDFATYYCQQATSFPYTFGQGTKLEIK

SEQ ID NO: 390 - protein, 117 aa, Artificial Sequence; identical to SEQ ID NO: 388
  CG_2_VH

SEQ ID NO: 391 - protein, 107 aa, Artificial Sequence
  CG_3_VL
DIQMTQSPSSVSASVGDRVTITCRASQGISSWLAWYQQKPGKAPKLLIYAASVLESGVPSRFSGSGSGTDFTLTISSLQPEDFATYYCQQAVEFPYTFGQGTKLEIK

SEQ ID NO: 392 - protein, 117 aa, Artificial Sequence; identical to SEQ ID NO: 388
  CG_3_VH

SEQ ID NO: 393 - protein, 107 aa, Artificial Sequence
  CG_4_VL
DIQMTQSPSSVSASVGDRVTITCRASQGISSWLAWYQQKPGKAPKLLIYAASVLESGVPSRFSGSGSGTDFTLTISSLQPEDFATYYCQQAQVFPYTFGQGTKLEIK

SEQ ID NO: 394 - protein, 117 aa, Artificial Sequence; identical to SEQ ID NO: 388
  CG_4_VH

SEQ ID NO: 395 - protein, 107 aa, Artificial Sequence
  CG_5_VL
DIQMTQSPSSVSASVGDRVTITCRASQGISSWLAWYQQKPGKAPKLLIYAASVLESGVPSRFSGSGSGTDFTLTISSLQPEDFATYYCQQATSAPYTFGQGTKLEIK

SEQ ID NO: 396 - protein, 117 aa, Artificial Sequence; identical to SEQ ID NO: 388
  CG_5_VH

SEQ ID NO: 397 - protein, 107 aa, Artificial Sequence
  CG_6_VL
DIQMTQSPSSVSASVGDRVTITCRASQGISSWLAWYQQKPGKAPKLLIYAASVLESGVPSRFSGSGSGTDFTLTISSLQPEDFATYYCQQANTMPYTFGQGTKLEIK

SEQ ID NO: 398 - protein, 117 aa, Artificial Sequence; identical to SEQ ID NO: 388
  CG_6_VH

SEQ ID NO: 399 - protein, 107 aa, Artificial Sequence
  CG_7_VL
DIQMTQSPSSVSASVGDRVTITCRASQGISSWLAWYQQKPGKAPKLLIYAASVLESGVPSRFSGSGSGTDFTLTISSLQPEDFATYYCQQATSVPYTFGQGTKLEIK

SEQ ID NO: 400 - protein, 117 aa, Artificial Sequence; identical to SEQ ID NO: 388
  CG_7_VH

SEQ ID NO: 401 - protein, 107 aa, Artificial Sequence
  CG_8_VL
DIQMTQSPSSVSASVGDRVTITCRASQGISSWLAWYQQKPGKAPKLLIYAASVLESGVPSRFSGSGSGTDFTLTISSLQPEDFATYYCQQADSAPYTFGQGTKLEIK

SEQ ID NO: 402 - protein, 117 aa, Artificial Sequence; identical to SEQ ID NO: 388
  CG_8_VH

SEQ ID NO: 403 - protein, 107 aa, Artificial Sequence
  CG_9_VL
DIQMTQSPSSVSASVGDRVTITCRASQGISSWLAWYQQKPGKAPKLLIYAASVLESGVPSRFSGSGSGTDFTLTISSLQPEDFATYYCQQADSVPYTFGQGTKLEIK

SEQ ID NO: 404 - protein, 117 aa, Artificial Sequence; identical to SEQ ID NO: 388
  CG_9_VH

SEQ ID NO: 405 - protein, 107 aa, Artificial Sequence
  CG_10_VL
DIQMTQSPSSVSASVGDRVTITCRASQGISSWLAWYQQKPGKAPKLLIYAASVLESGVPSRFSGSGSGTDFTLTISSLQPEDFATYYCQQAVQFPYTFGQGTKLEIK

SEQ ID NO: 406 - protein, 117 aa, Artificial Sequence; identical to SEQ ID NO: 388
  CG_10_VH

SEQ ID NO: 407 - protein, 107 aa, Artificial Sequence
  CG_11_VL
DIQMTQSPSSVSASVGDRVTITCRASQGISSWLAWYQQKPGKAPKLLIYAASVLESGVPSRFSGSGSGTDFTLTISSLQPEDFATYYCQQAVTFPYTFGQGTKLEIK

SEQ ID NO: 408 - protein, 117 aa, Artificial Sequence; identical to SEQ ID NO: 388
  CG_11_VH

SEQ ID NO: 409 - protein, 107 aa, Artificial Sequence
  CG_12_VL
DIQMTQSPSSVSASVGDRVTITCRASQGISSWLAWYQQKPGKAPKLLIYAASVLESGVPSRFSGSGSGTDFTLTISSLQPEDFATYYCQQANTAPYTFGQGTKLEIK

SEQ ID NO: 410 - protein, 117 aa, Artificial Sequence; identical to SEQ ID NO: 388
  CG_12_VH

SEQ ID NO: 411 - protein, 107 aa, Artificial Sequence
  CG_13_VL
DIQMTQSPSSVSASVGDRVTITCRASQGISSWLAWYQQKPGKAPKLLIYASSVLESGVPSRFSGSGSGTDFTLTISSLQPEDFATYYCQQANSFPYTFGQGTKLEIK

SEQ ID NO: 412 - protein, 117 aa, Artificial Sequence; identical to SEQ ID NO: 388
  CG_13_VH

SEQ ID NO: 413 - protein, 107 aa, Artificial Sequence
  CG_14_VL
DIQMTQSPSSVSASVGDRVTITCRASQGISSWLAWYQQKPGKAPKLLIYAASILESGVPSRFSGSGSGTDFTLTISSLQPEDFATYYCQQANSFPYTFGQGTKLEIK

SEQ ID NO: 414 - protein, 117 aa, Artificial Sequence; identical to SEQ ID NO: 388
  CG_14_VH

SEQ ID NO: 415 - protein, 107 aa, Artificial Sequence
  CG_15_VL
DIQMTQSPSSVSASVGDRVTITCRASQGISSWLAWYQQKPGKAPKLLIYAASALESGVPSRFSGSGSGTDFTLTISSLQPEDFATYYCQQANSFPYTFGQGTKLEIK

SEQ ID NO: 416 - protein, 117 aa, Artificial Sequence; identical to SEQ ID NO: 388
  CG_15_VH

SEQ ID NO: 417 - protein, 107 aa, Artificial Sequence
  CG_16_VL
DIQMTQSPSSVSASVGDRVTITCRASQGISSWLAWYQQKPGKAPKLLIYAAEVLESGVPSRFSGSGSGTDFTLTISSLQPEDFATYYCQQANSFPYTFGQGTKLEIK

SEQ ID NO: 418 - protein, 117 aa, Artificial Sequence; identical to SEQ ID NO: 388
  CG_16_VH

SEQ ID NO: 419 - protein, 107 aa, Artificial Sequence
  CG_17_VL
DIQMTQSPSSVSASVGDRVTITCRASQGISSWLAWYQQKPGKAPKLLIYAATVLESGVPSRFSGSGSGTDFTLTISSLQPEDFATYYCQQANSFPYTFGQGTKLEIK

SEQ ID NO: 420 - protein, 117 aa, Artificial Sequence; identical to SEQ ID NO: 388
  CG_17_VH

SEQ ID NO: 421 - protein, 107 aa, Artificial Sequence
  CG_18_VL
DIQMTQSPSSVSASVGDRVTITCRASQGISSWLAWYQQKPGKAPKLLIYAAYVLESGVPSRFSGSGSGTDFTLTISSLQPEDFATYYCQQANSFPYTFGQGTKLEIK

SEQ ID NO: 422 - protein, 117 aa, Artificial Sequence; identical to SEQ ID NO: 388
  CG_18_VH

SEQ ID NO: 423 - protein, 107 aa, Artificial Sequence
  CG_19_VL
DIQMTQSPSSVSASVGDRVTITCRASQGISSWLAWYQQKPGKAPKLLIYAAQILESGVPSRFSGSGSGTDFTLTISSLQPEDFATYYCQQANSFPYTFGQGTKLEIK

SEQ ID NO: 424 - protein, 117 aa, Artificial Sequence; identical to SEQ ID NO: 388
  CG_19_VH

SEQ ID NO: 425 - protein, 107 aa, Artificial Sequence
  CG_20_VL
DIQMTQSPSSVSASVGDRVTITCRASQGISSWLAWYQQKPGKAPKLLIYAATILESGVPSRFSGSGSGTDFTLTISSLQPEDFATYYCQQANSFPYTFGQGTKLEIK

SEQ ID NO: 426 - protein, 117 aa, Artificial Sequence; identical to SEQ ID NO: 388
  CG_20_VH

SEQ ID NO: 427 - protein, 107 aa, Artificial Sequence
  CG_21_VL
DIQMTQSPSSVSASVGDRVTITCRASQGISSWLAWYQQKPGKAPKLLIYAAVFLESGVPSRFSGSGSGTDFTLTISSLQPEDFATYYCQQANSFPYTFGQGTKLEIK

SEQ ID NO: 428 - protein, 117 aa, Artificial Sequence; identical to SEQ ID NO: 388
  CG_21_VH

SEQ ID NO: 429 - protein, 107 aa, Artificial Sequence
  CG_22_VL
DIQMTQSPSSVSASVGDRVTITCRASQGISSWLAWYQQKPGKAPKLLIYAAVYLESGVPSRFSGSGSGTDFTLTISSLQPEDFATYYCQQANSFPYTFGQGTKLEIK

SEQ ID NO: 430 - protein, 117 aa, Artificial Sequence; identical to SEQ ID NO: 388
  CG_22_VH

SEQ ID NO: 431 - protein, 107 aa, Artificial Sequence
  CG_23_VL
DIQMTQSPSSVSASVGDRVTITCRASQGITSWLAWYQQKPGKAPKLLIYAASVLESGVPSRFSGSGSGTDFTLTISSLQPEDFATYYCQQANSFPYTFGQGTKLEIK

SEQ ID NO: 432 - protein, 117 aa, Artificial Sequence; identical to SEQ ID NO: 388
  CG_23_VH

SEQ ID NO: 433 - protein, 107 aa, Artificial Sequence
  CG_24_VL
DIQMTQSPSSVSASVGDRVTITCRASQSISSWLAWYQQKPGKAPKLLIYAASVLESGVPSRFSGSGSGTDFTLTISSLQPEDFATYYCQQANSFPYTFGQGTKLEIK

SEQ ID NO: 434 - protein, 117 aa, Artificial Sequence; identical to SEQ ID NO: 388
  CG_24_VH

SEQ ID NO: 435 - protein, 107 aa, Artificial Sequence
  CG_25_VL
DIQMTQSPSSVSASVGDRVTITCRASQGVSSWLAWYQQKPGKAPKLLIYAASVLESGVPSRFSGSGSGTDFTLTISSLQPEDFATYYCQQANSFPYTFGQGTKLEIK

SEQ ID NO: 436 - protein, 117 aa, Artificial Sequence; identical to SEQ ID NO: 388
  CG_25_VH

SEQ ID NO: 437 - protein, 107 aa, Artificial Sequence
  CG_26_VL
DIQMTQSPSSVSASVGDRVTITCRASQGLSSWLAWYQQKPGKAPKLLIYAASVLESGVPSRFSGSGSGTDFTLTISSLQPEDFATYYCQQANSFPYTFGQGTKLEIK

SEQ ID NO: 438 - protein, 117 aa, Artificial Sequence; identical to SEQ ID NO: 388
  CG_26_VH

SEQ ID NO: 439 - protein, 107 aa, Artificial Sequence
  CG_27_VL
DIQMTQSPSSVSASVGDRVTITCRASEGISSWLAWYQQKPGKAPKLLIYAASVLESGVPSRFSGSGSGTDFTLTISSLQPEDFATYYCQQANSFPYTFGQGTKLEIK

SEQ ID NO: 440 - protein, 117 aa, Artificial Sequence; identical to SEQ ID NO: 388
  CG_27_VH

SEQ ID NO: 441 - protein, 107 aa, Artificial Sequence
  CG_28_VL
DIQMTQSPSSVSASVGDRVTITCRASQYIESWLAWYQQKPGKAPKLLIYAASVLESGVPSRFSGSGSGTDFTLTISSLQPEDFATYYCQQANSFPYTFGQGTKLEIK

SEQ ID NO: 442 - protein, 117 aa, Artificial Sequence; identical to SEQ ID NO: 388
  CG_28_VH

SEQ ID NO: 443 - protein, 107 aa, Artificial Sequence
  CG_29_VL
DIQMTQSPSSVSASVGDRVTITCRASQHITSWLAWYQQKPGKAPKLLIYAASVLESGVPSRFSGSGSGTDFTLTISSLQPEDFATYYCQQANSFPYTFGQGTKLEIK

SEQ ID NO: 444 - protein, 117 aa, Artificial Sequence; identical to SEQ ID NO: 388
  CG_29_VH

SEQ ID NO: 445 - protein, 107 aa, Artificial Sequence
  CG_30_VL
DIQMTQSPSSVSASVGDRVTITCRATEGISSWLAWYQQKPGKAPKLLIYAASVLESGVPSRFSGSGSGTDFTLTISSLQPEDFATYYCQQANSFPYTFGQGTKLEIK

SEQ ID NO: 446 - protein, 117 aa, Artificial Sequence; identical to SEQ ID NO: 388
  CG_30_VH

SEQ ID NO: 447 - protein, 107 aa, Artificial Sequence
  CG_31_VL
DIQMTQSPSSVSASVGDRVTITCRASQYIQSWLAWYQQKPGKAPKLLIYAASVLESGVPSRFSGSGSGTDFTLTISSLQPEDFATYYCQQANSFPYTFGQGTKLEIK

SEQ ID NO: 448 - protein, 117 aa, Artificial Sequence; identical to SEQ ID NO: 388
  CG_31_VH

SEQ ID NO: 449 - protein, 107 aa, Artificial Sequence
  CG_32_VL
DIQMTQSPSSVSASVGDRVTITCRASQYISSWLAWYQQKPGKAPKLLIYAASVLESGVPSRFSGSGSGTDFTLTISSLQPEDFATYYCQQANSFPYTFGQGTKLEIK

SEQ ID NO: 450 - protein, 117 aa, Artificial Sequence; identical to SEQ ID NO: 388
  CG_32_VH

SEQ ID NO: 451 - protein, 107 aa, Artificial Sequence
  CG_33_VL
DIQMTQSPSSVSASVGDRVTITCRASQYIASWLAWYQQKPGKAPKLLIYAASVLESGVPSRFSGSGSGTDFTLTISSLQPEDFATYYCQQANSFPYTFGQGTKLEIK

SEQ ID NO: 452 - protein, 117 aa, Artificial Sequence; identical to SEQ ID NO: 388
  CG_33_VH

SEQ ID NO: 453 - protein, 107 aa, Artificial Sequence
  CG_34_VL
DIQMTQSPSSVSASVGDRVTITCRASQYITSWLAWYQQKPGKAPKLLIYAASVLESGVPSRFSGSGSGTDFTLTISSLQPEDFATYYCQQANSFPYTFGQGTKLEIK

SEQ ID NO: 454 - protein, 117 aa, Artificial Sequence; identical to SEQ ID NO: 388
  CG_34_VH

SEQ ID NO: 455 - protein, 107 aa, Artificial Sequence; identical to SEQ ID NO: 383
  CG_35_VL

SEQ ID NO: 456 - protein, 117 aa, Artificial Sequence; identical to SEQ ID NO: 388
  CG_35_VH

SEQ ID NO: 457 - protein, 107 aa, Artificial Sequence; identical to SEQ ID NO: 383
  CG_36_VL

SEQ ID NO: 458 - protein, 117 aa, Artificial Sequence
  CG_36_VH
EVQLLESGGGLVQPGGSLRLSCAASGFTFPNFVMSWVRQAPGKGLEWVSTISGSGGSTYYADSVKGRFTISRDNSKNMLYLQMNSLRAEDTAVYYCAKHSILRYFDWLAGTLVTVSS

SEQ ID NO: 459 - protein, 107 aa, Artificial Sequence; identical to SEQ ID NO: 383
  CG_37_VL

SEQ ID NO: 460 - protein, 117 aa, Artificial Sequence
  CG_37_VH
EVQLLESGGGLVQPGGSLRLSCAASGFTFPNFVMSWVRQAPGKGLEWVSTISGSGGSTYYADSVKGRFTISRDNSKNMLYLQMNSLRAEDTAVYYCAKHTILRYFDWLAGTLVTVSS

SEQ ID NO: 461 - protein, 107 aa, Artificial Sequence; identical to SEQ ID NO: 383
  CG_38_VL

SEQ ID NO: 462 - protein, 117 aa, Artificial Sequence
  CG_38_VH
EVQLLESGGGLVQPGGSLRLSCAASGFTFPNFVMSWVRQAPGKGLEWVSTISGSGGSTYYADSVKGRFTISRDNSKNMLYLQMNSLRAEDTAVYYCAKHHILRSFDWLAGTLVTVSS

SEQ ID NO: 463 - protein, 107 aa, Artificial Sequence; identical to SEQ ID NO: 383
  CG_39_VL

SEQ ID NO: 464 - protein, 117 aa, Artificial Sequence
  CG_39_VH
EVQLLESGGGLVQPGGSLRLSCAASGFTFPNFVMSWVRQAPGKGLEWVSTISGSGGSTYYADSVKGRFTISRDNSKNMLYLQMNSLRAEDTAVYYCAKHHILKYFDWLAGTLVTVSS

SEQ ID NO: 465 - protein, 107 aa, Artificial Sequence; identical to SEQ ID NO: 383
  CG_40_VL

SEQ ID NO: 466 - protein, 117 aa, Artificial Sequence
  CG_40_VH
EVQLLESGGGLVQPGGSLRLSCAASGFTFPNFVMSWVRQAPGKGLEWVSTISGSGGSTYYADSVKGRFTISRDNSKNMLYLQMNSLRAEDTAVYYCAKHHVIRYFDWLAGTLVTVSS

SEQ ID NO: 467 - protein, 107 aa, Artificial Sequence; identical to SEQ ID NO: 383
  CG_41_VL

SEQ ID NO: 468 - protein, 117 aa, Artificial Sequence
  CG_41_VH
EVQLLESGGGLVQPGGSLRLSCAASGFTFPNFVMSWVRQAPGKGLEWVSTISGSGGSTYYADSVKGRFTISRDNSKNMLYLQMNSLRAEDTAVYYCAKHVILRYFDWLAGTLVTVSS

SEQ ID NO: 469 - protein, 107 aa, Artificial Sequence; identical to SEQ ID NO: 383
  CG_42_VL

SEQ ID NO: 470 - protein, 117 aa, Artificial Sequence; identical to SEQ ID NO: 384
  CG_42_VH

SEQ ID NO: 471 - protein, 107 aa, Artificial Sequence; identical to SEQ ID NO: 383
  CG_43_VL

SEQ ID NO: 472 - protein, 117 aa, Artificial Sequence
  CG_43_VH
EVQLLESGGGLVQPGGSLRLSCAASGFTFPNFVMSWVRQAPGKGLEWVSTISGSGGSTYYADSVKGRFTISRDNSKNMLYLQMNSLRAEDTAVYYCAKHLYLRYFDWLAGTLVTVSS

SEQ ID NO: 473 - protein, 107 aa, Artificial Sequence; identical to SEQ ID NO: 383
  CG_44_VL

SEQ ID NO: 474 - protein, 117 aa, Artificial Sequence
  CG_44_VH
EVQLLESGGGLVQPGGSLRLSCAASGFTFPNFVMSWVRQAPGKGLEWVSTISGAGGSTYYADSVKGRFTISRDNSKNMLYLQMNSLRAEDTAVYYCAKHHILRYFDWLAGTLVTVSS

SEQ ID NO: 475 - protein, 107 aa, Artificial Sequence; identical to SEQ ID NO: 383
  CG_45_VL

SEQ ID NO: 476 - protein, 117 aa, Artificial Sequence
  CG_45_VH
EVQLLESGGGLVQPGGSLRLSCAASGFTFPNFVMSWVRQAPGKGLEWVSTISGSGGSSYYADSVKGRFTISRDNSKNMLYLQMNSLRAEDTAVYYCAKHHILRYFDWLAGTLVTVSS

SEQ ID NO: 477 - protein, 107 aa, Artificial Sequence; identical to SEQ ID NO: 383
  CG_46_VL

SEQ ID NO: 478 - protein, 117 aa, Artificial Sequence
  CG_46_VH
EVQLLESGGGLVQPGGSLRLSCAASGFTFPNFVMSWVRQAPGKGLEWVSTISGTGGSTYYADSVKGRFTISRDNSKNMLYLQMNSLRAEDTAVYYCAKHHILRYFDWLAGTLVTVSS

SEQ ID NO: 479 - protein, 107 aa, Artificial Sequence; identical to SEQ ID NO: 383
  CG_47_VL

SEQ ID NO: 480 - protein, 117 aa, Artificial Sequence
  CG_47_VH
EVQLLESGGGLVQPGGSLRLSCAASGFTFPNFVMSWVRQAPGKGLEWVSTISGTGSSTYYADSVKGRFTISRDNSKNMLYLQMNSLRAEDTAVYYCAKHHILRYFDWLAGTLVTVSS

SEQ ID NO: 481 - protein, 107 aa, Artificial Sequence; identical to SEQ ID NO: 383
  CG_48_VL

SEQ ID NO: 482 - protein, 117 aa, Artificial Sequence
  CG_48_VH
EVQLLESGGGLVQPGGSLRLSCAASGFTFPNFVMSWVRQAPGKGLEWVSTISGYGGSTYYADSVKGRFTISRDNSKNMLYLQMNSLRAEDTAVYYCAKHHILRYFDWLAGTLVTVSS

SEQ ID NO: 483 - protein, 107 aa, Artificial Sequence; identical to SEQ ID NO: 383
  CG_49_VL

SEQ ID NO: 484 - protein, 117 aa, Artificial Sequence
  CG_49_VH
EVQLLESGGGLVQPGGSLRLSCAASGFTFPNFVMSWVRQAPGKGLEWVSTISGHGGSTYYADSVKGRFTISRDNSKNMLYLQMNSLRAEDTAVYYCAKHHILRYFDWLAGTLVTVSS

SEQ ID NO: 485 - protein, 107 aa, Artificial Sequence; identical to SEQ ID NO: 383
  CG_50_VL

SEQ ID NO: 486 - protein, 117 aa, Artificial Sequence
  CG_50_VH
EVQLLESGGGLVQPGGSLRLSCAASGFTFPNFVMSWVRQAPGKGLEWVSTISGHGGATYYADSVKGRFTISRDNSKNMLYLQMNSLRAEDTAVYYCAKHHILRYFDWLAGTLVTVSS

SEQ ID NO: 487 - protein, 107 aa, Artificial Sequence; identical to SEQ ID NO: 383
  CG_51_VL

SEQ ID NO: 488 - protein, 117 aa, Artificial Sequence
  CG_51_VH
EVQLLESGGGLVQPGGSLRLSCAASGFTFPNFVMSWVRQAPGKGLEWVSTISGEGGLTYYADSVKGRFTISRDNSKNMLYLQMNSLRAEDTAVYYCAKHHILRYFDWLAGTLVTVSS

SEQ ID NO: 489 - protein, 107 aa, Artificial Sequence; identical to SEQ ID NO: 383
  CG_52_VL

SEQ ID NO: 490 - protein, 117 aa, Artificial Sequence
  CG_52_VH
EVQLLESGGGLVQPGGSLRLSCAASGFTFPNFVMSWVRQAPGKGLEWVSTISGHGGTTYYADSVKGRFTISRDNSKNMLYLQMNSLRAEDTAVYYCAKHHILRYFDWLAGTLVTVSS

SEQ ID NO: 491 - protein, 107 aa, Artificial Sequence; identical to SEQ ID NO: 383
  CG_53_VL

SEQ ID NO: 492 - protein, 117 aa, Artificial Sequence
  CG_53_VH
EVQLLESGGGLVQPGGSLRLSCAASGFTFPNFVMSWVRQAPGKGLEWVSTISGYGGTTYYADSVKGRFTISRDNSKNMLYLQMNSLRAEDTAVYYCAKHHILRYFDWLAGTLVTVSS

SEQ ID NO: 493 - protein, 107 aa, Artificial Sequence; identical to SEQ ID NO: 383
  CG_54_VL

SEQ ID NO: 494 - protein, 117 aa, Artificial Sequence
  CG_54_VH
EVQLLESGGGLVQPGGSLRLSCAASGFTFPNFVMSWVRQAPGKGLEWVSTISGYGGATYYADSVKGRFTISRDNSKNMLYLQMNSLRAEDTAVYYCAKHHILRYFDWLAGTLVTVSS

SEQ ID NO: 495 - protein, 107 aa, Artificial Sequence; identical to SEQ ID NO: 383
  CG_55_VL

SEQ ID NO: 496 - protein, 117 aa, Artificial Sequence
  CG_55_VH
EVQLLESGGGLVQPGGSLRLSCAASGFTFPNFVMSWVRQAPGKGLEWVSTISGDGGLTYYADSVKGRFTISRDNSKNMLYLQMNSLRAEDTAVYYCAKHHILRYFDWLAGTLVTVSS

SEQ ID NO: 497 - protein, 107 aa, Artificial Sequence; identical to SEQ ID NO: 383
  CG_56_VL

SEQ ID NO: 498 - protein, 117 aa, Artificial Sequence
  CG_56_VH
EVQLLESGGGLVQPGGSLRLSCAASGFTFPNFVMSWVRQAPGKGLEWVSTISGTGGLTYYADSVKGRFTISRDNSKNMLYLQMNSLRAEDTAVYYCAKHHILRYFDWLAGTLVTVSS

SEQ ID NO: 499 - protein, 107 aa, Artificial Sequence; identical to SEQ ID NO: 383
  CG_57_VL

SEQ ID NO: 500 - protein, 117 aa, Artificial Sequence
  CG_57_VH
EVQLLESGGGLVQPGGSLRLSCAASGFTFPDFVMSWVRQAPGKGLEWVSTISGSGGSTYYADSVKGRFTISRDNSKNMLYLQMNSLRAEDTAVYYCAKHHILRYFDWLAGTLVTVSS

SEQ ID NO: 501 - protein, 107 aa, Artificial Sequence; identical to SEQ ID NO: 383
  CG_58_VL

SEQ ID NO: 502 - protein, 117 aa, Artificial Sequence
  CG_58_VH
EVQLLESGGGLVQPGGSLRLSCAASGFTFPEFVMSWVRQAPGKGLEWVSTISGSGGSTYYADSVKGRFTISRDNSKNMLYLQMNSLRAEDTAVYYCAKHHILRYFDWLAGTLVTVSS

SEQ ID NO: 503 - protein, 107 aa, Artificial Sequence; identical to SEQ ID NO: 383
  CG_59_VL

SEQ ID NO: 504 - protein, 117 aa, Artificial Sequence
  CG_59_VH
EVQLLESGGGLVQPGGSLRLSCAASGFTFPQFVMSWVRQAPGKGLEWVSTISGSGGSTYYADSVKGRFTISRDNSKNMLYLQMNSLRAEDTAVYYCAKHHILRYFDWLAGTLVTVSS

SEQ ID NO: 505 - protein, 107 aa, Artificial Sequence; identical to SEQ ID NO: 383
  CG_60_VL

SEQ ID NO: 506 - protein, 117 aa, Artificial Sequence
  CG_60_VH
EVQLLESGGGLVQPGGSLRLSCAASGFSFVNFVMSWVRQAPGKGLEWVSTISGSGGSTYYADSVKGRFTISRDNSKNMLYLQMNSLRAEDTAVYYCAKHHILRYFDWLAGTLVTVSS

SEQ ID NO: 507 - protein, 107 aa, Artificial Sequence; identical to SEQ ID NO: 383
  CG_61_VL

SEQ ID NO: 508 - protein, 117 aa, Artificial Sequence
  CG_61_VH
EVQLLESGGGLVQPGGSLRLSCAASGFTFVDFVMSWVRQAPGKGLEWVSTISGSGGSTYYADSVKGRFTISRDNSKNMLYLQMNSLRAEDTAVYYCAKHHILRYFDWLAGTLVTVSS

SEQ ID NO: 509 - protein, 107 aa, Artificial Sequence; identical to SEQ ID NO: 383
  CG_62_VL

SEQ ID NO: 510 - protein, 117 aa, Artificial Sequence
  CG_62_VH
EVQLLESGGGLVQPGGSLRLSCAASGFTFLDFVMSWVRQAPGKGLEWVSTISGSGGSTYYADSVKGRFTISRDNSKNMLYLQMNSLRAEDTAVYYCAKHHILRYFDWLAGTLVTVSS

SEQ ID NO: 511 - protein, 107 aa, Artificial Sequence; identical to SEQ ID NO: 383
  CG_63_VL

SEQ ID NO: 512 - protein, 117 aa, Artificial Sequence
  CG_63_VH
EVQLLESGGGLVQPGGSLRLSCAASGFTFYEFVMSWVRQAPGKGLEWVSTISGSGGSTYYADSVKGRFTISRDNSKNMLYLQMNSLRAEDTAVYYCAKHHILRYFDWLAGTLVTVSS

SEQ ID NO: 513 - protein, 11 aa, Artificial Sequence
  CG_1_VL_CDR1
RASQGISSWLA

SEQ ID NO: 514 - protein, 7 aa, Artificial Sequence
  CG_1_VL_CDR2
AASVLES

SEQ ID NO: 515 - protein, 9 aa, Artificial Sequence
  CG_1_VL_CDR3
QQANTFPYT

SEQ ID NO: 516 - protein, 5 aa, Artificial Sequence
  CG_1_VH_CDR1
NFVMS

SEQ ID NO: 517 - protein, 17 aa, Artificial Sequence
  CG_1_VH_CDR2
TISGSGGSTYYADSVKG

SEQ ID NO: 518 - protein, 7 aa, Artificial Sequence
  CG_1_VH_CDR3
HILRYFD

SEQ ID NO: 519 - protein, 11 aa, Artificial Sequence
  CG_2_VL_CDR1
RASQGISSWLA

SEQ ID NO: 520 - protein, 7 aa, Artificial Sequence
  CG_2_VL_CDR2
AASVLES

SEQ ID NO: 521 - protein, 9 aa, Artificial Sequence
  CG_2_VL_CDR3
QQATSFPYT

SEQ ID NO: 522 - protein, 5 aa, Artificial Sequence
  CG_2_VH_CDR1
NFVMS

SEQ ID NO: 523 - protein, 17 aa, Artificial Sequence
  CG_2_VH_CDR2
TISGSGGSTYYADSVKG

SEQ ID NO: 524 - protein, 7 aa, Artificial Sequence
  CG_2_VH_CDR3
HILRYFD

SEQ ID NO: 525 - protein, 11 aa, Artificial Sequence
  CG_3_VL_CDR1
RASQGISSWLA

SEQ ID NO: 526 - protein, 7 aa, Artificial Sequence
  CG_3_VL_CDR2
AASVLES

SEQ ID NO: 527 - protein, 9 aa, Artificial Sequence
  CG_3_VL_CDR3
QQAVEFPYT

SEQ ID NO: 528 - protein, 5 aa, Artificial Sequence
  CG_3_VH_CDR1
NFVMS

SEQ ID NO: 529 - protein, 17 aa, Artificial Sequence
  CG_3_VH_CDR2
TISGSGGSTYYADSVKG

SEQ ID NO: 530 - protein, 7 aa, Artificial Sequence
  CG_3_VH_CDR3
HILRYFD

SEQ ID NO: 531 - protein, 11 aa, Artificial Sequence
  CG_4_VL_CDR1
RASQGISSWLA

SEQ ID NO: 532 - protein, 7 aa, Artificial Sequence
  CG_4_VL_CDR2
AASVLES

SEQ ID NO: 533 - protein, 9 aa, Artificial Sequence
  CG_4_VL_CDR3
QQAQVFPYT

SEQ ID NO: 534 - protein, 5 aa, Artificial Sequence
  CG_4_VH_CDR1
NFVMS

SEQ ID NO: 535 - protein, 17 aa, Artificial Sequence
  CG_4_VH_CDR2
TISGSGGSTYYADSVKG

SEQ ID NO: 536 - protein, 7 aa, Artificial Sequence
  CG_4_VH_CDR3
HILRYFD

SEQ ID NO: 537 - protein, 11 aa, Artificial Sequence
  CG_5_VL_CDR1
RASQGISSWLA

SEQ ID NO: 538 - protein, 7 aa, Artificial Sequence
  CG_5_VL_CDR2
AASVLES

SEQ ID NO: 539 - protein, 9 aa, Artificial Sequence
  CG_5_VL_CDR3
QQATSAPYT

SEQ ID NO: 540 - protein, 5 aa, Artificial Sequence
  CG_5_VH_CDR1
NFVMS

SEQ ID NO: 541 - protein, 17 aa, Artificial Sequence
  CG_5_VH_CDR2
TISGSGGSTYYADSVKG

SEQ ID NO: 542 - protein, 7 aa, Artificial Sequence
  CG_5_VH_CDR3
HILRYFD

SEQ ID NO: 543 - protein, 11 aa, Artificial Sequence
  CG_6_VL_CDR1
RASQGISSWLA

SEQ ID NO: 544 - protein, 7 aa, Artificial Sequence
  CG_6_VL_CDR2
AASVLES

SEQ ID NO: 545 - protein, 9 aa, Artificial Sequence
  CG_6_VL_CDR3
QQANTMPYT

SEQ ID NO: 546 - protein, 5 aa, Artificial Sequence
  CG_6_VH_CDR1
NFVMS

SEQ ID NO: 547 - protein, 17 aa, Artificial Sequence
  CG_6_VH_CDR2
TISGSGGSTYYADSVKG

SEQ ID NO: 548 - protein, 7 aa, Artificial Sequence
  CG_6_VH_CDR3
HILRYFD

SEQ ID NO: 549 - protein, 11 aa, Artificial Sequence
  CG_7_VL_CDR1
RASQGISSWLA

SEQ ID NO: 550 - protein, 7 aa, Artificial Sequence
  CG_7_VL_CDR2
AASVLES

SEQ ID NO: 551 - protein, 9 aa, Artificial Sequence
  CG_7_VL_CDR3
QQATSVPYT

SEQ ID NO: 552 - protein, 5 aa, Artificial Sequence
  CG_7_VH_CDR1
NFVMS

SEQ ID NO: 553 - protein, 17 aa, Artificial Sequence
  CG_7_VH_CDR2
TISGSGGSTYYADSVKG

SEQ ID NO: 554 - protein, 7 aa, Artificial Sequence
  CG_7_VH_CDR3
HILRYFD

SEQ ID NO: 555 - protein, 11 aa, Artificial Sequence
  CG_8_VL_CDR1
RASQGISSWLA

SEQ ID NO: 556 - protein, 7 aa, Artificial Sequence
  CG_8_VL_CDR2
AASVLES

SEQ ID NO: 557 - protein, 9 aa, Artificial Sequence
  CG_8_VL_CDR3
QQADSAPYT

SEQ ID NO: 558 - protein, 5 aa, Artificial Sequence
  CG_8_VH_CDR1
NFVMS

SEQ ID NO: 559 - protein, 17 aa, Artificial Sequence
  CG_8_VH_CDR2
TISGSGGSTYYADSVKG

SEQ ID NO: 560 - protein, 7 aa, Artificial Sequence
  CG_8_VH_CDR3
HILRYFD

SEQ ID NO: 561 - protein, 11 aa, Artificial Sequence
  CG_9_VL_CDR1
RASQGISSWLA

SEQ ID NO: 562 - protein, 7 aa, Artificial Sequence
  CG_9_VL_CDR2
AASVLES

SEQ ID NO: 563 - protein, 9 aa, Artificial Sequence
  CG_9_VL_CDR3
QQADSVPYT

SEQ ID NO: 564 - protein, 5 aa, Artificial Sequence
  CG_9_VH_CDR1
NFVMS

SEQ ID NO: 565 - protein, 17 aa, Artificial Sequence
  CG_9_VH_CDR2
TISGSGGSTYYADSVKG

SEQ ID NO: 566 - protein, 7 aa, Artificial Sequence
  CG_9_VH_CDR3
HILRYFD

SEQ ID NO: 567 - protein, 11 aa, Artificial Sequence
  CG_10_VL_CDR1
RASQGISSWLA

SEQ ID NO: 568 - protein, 7 aa, Artificial Sequence
  CG_10_VL_CDR2
AASVLES

SEQ ID NO: 569 - protein, 9 aa, Artificial Sequence
  CG_10_VL_CDR3
QQAVQFPYT

SEQ ID NO: 570 - protein, 5 aa, Artificial Sequence
  CG_10_VH_CDR1
NFVMS

SEQ ID NO: 571 - protein, 17 aa, Artificial Sequence
  CG_10_VH_CDR2
TISGSGGSTYYADSVKG

SEQ ID NO: 572 - protein, 7 aa, Artificial Sequence
  CG_10_VH_CDR3
HILRYFD

SEQ ID NO: 573 - protein, 11 aa, Artificial Sequence
  CG_11_VL_CDR1
RASQGISSWLA

SEQ ID NO: 574 - protein, 7 aa, Artificial Sequence
  CG_11_VL_CDR2
AASVLES

SEQ ID NO: 575 - protein, 9 aa, Artificial Sequence
  CG_11_VL_CDR3
QQAVTFPYT

SEQ ID NO: 576 - protein, 5 aa, Artificial Sequence
  CG_11_VH_CDR1
NFVMS

SEQ ID NO: 577 - protein, 17 aa, Artificial Sequence
  CG_11_VH_CDR2
TISGSGGSTYYADSVKG

SEQ ID NO: 578 - protein, 7 aa, Artificial Sequence
  CG_11_VH_CDR3
HILRYFD

SEQ ID NO: 579 - protein, 11 aa, Artificial Sequence
  CG_12_VL_CDR1
RASQGISSWLA

SEQ ID NO: 580 - protein, 7 aa, Artificial Sequence
  CG_12_VL_CDR2
AASVLES

SEQ ID NO: 581 - protein, 9 aa, Artificial Sequence
  CG_12_VL_CDR3
QQANTAPYT

SEQ ID NO: 582 - protein, 5 aa, Artificial Sequence
  CG_12_VH_CDR1
NFVMS

SEQ ID NO: 583 - protein, 17 aa, Artificial Sequence
  CG_12_VH_CDR2
TISGSGGSTYYADSVKG

SEQ ID NO: 584 - protein, 7 aa, Artificial Sequence
  CG_12_VH_CDR3
HILRYFD

SEQ ID NO: 585 - protein, 11 aa, Artificial Sequence
  CG_13_VL_CDR1
RASQGISSWLA

SEQ ID NO: 586 - protein, 7 aa, Artificial Sequence
  CG_13_VL_CDR2
ASSVLES

SEQ ID NO: 587 - protein, 9 aa, Artificial Sequence
  CG_13_VL_CDR3
QQANSFPYT

SEQ ID NO: 588 - protein, 5 aa, Artificial Sequence
  CG_13_VH_CDR1
NFVMS

SEQ ID NO: 589 - protein, 17 aa, Artificial Sequence
  CG_13_VH_CDR2
TISGSGGSTYYADSVKG

SEQ ID NO: 590 - protein, 7 aa, Artificial Sequence
  CG_13_VH_CDR3
HILRYFD

SEQ ID NO: 591 - protein, 11 aa, Artificial Sequence
  CG_14_VL_CDR1
RASQGISSWLA

SEQ ID NO: 592 - protein, 7 aa, Artificial Sequence
  CG_14_VL_CDR2
AASILES

SEQ ID NO: 593 - protein, 9 aa, Artificial Sequence
  CG_14_VL_CDR3
QQANSFPYT

SEQ ID NO: 594 - protein, 5 aa, Artificial Sequence
  CG_14_VH_CDR1
NFVMS

SEQ ID NO: 595 - protein, 17 aa, Artificial Sequence
  CG_14_VH_CDR2
TISGSGGSTYYADSVKG

SEQ ID NO: 596 - protein, 7 aa, Artificial Sequence
  CG_14_VH_CDR3
HILRYFD

SEQ ID NO: 597 - protein, 11 aa, Artificial Sequence
  CG_15_VL_CDR1
RASQGISSWLA

SEQ ID NO: 598 - protein, 7 aa, Artificial Sequence
  CG_15_VL_CDR2
AASALES

SEQ ID NO: 599 - protein, 9 aa, Artificial Sequence
  CG_15_VL_CDR3
QQANSFPYT

SEQ ID NO: 600 - protein, 5 aa, Artificial Sequence
  CG_15_VH_CDR1
NFVMS

SEQ ID NO: 601 - protein, 17 aa, Artificial Sequence
  CG_15_VH_CDR2
TISGSGGSTYYADSVKG

SEQ ID NO: 602 - protein, 7 aa, Artificial Sequence
  CG_15_VH_CDR3
HILRYFD

SEQ ID NO: 603 - protein, 11 aa, Artificial Sequence
  CG_16_VL_CDR1
RASQGISSWLA

SEQ ID NO: 604 - protein, 7 aa, Artificial Sequence
  CG_16_VL_CDR2
AAEVLES

SEQ ID NO: 605 - protein, 9 aa, Artificial Sequence
  CG_16_VL_CDR3
QQANSFPYT

SEQ ID NO: 606 - protein, 5 aa, Artificial Sequence
  CG_16_VH_CDR1
NFVMS

SEQ ID NO: 607 - protein, 17 aa, Artificial Sequence
  CG_16_VH_CDR2
TISGSGGSTYYADSVKG

SEQ ID NO: 608 - protein, 7 aa, Artificial Sequence
  CG_16_VH_CDR3
HILRYFD

SEQ ID NO: 609 - protein, 11 aa, Artificial Sequence
  CG_17_VL_CDR1
RASQGISSWLA

SEQ ID NO: 610 - protein, 7 aa, Artificial Sequence
  CG_17_VL_CDR2
AATVLES

SEQ ID NO: 611 - protein, 9 aa, Artificial Sequence
  CG_17_VL_CDR3
QQANSFPYT

SEQ ID NO: 612 - protein, 5 aa, Artificial Sequence
  CG_17_VH_CDR1
NFVMS

SEQ ID NO: 613 - protein, 17 aa, Artificial Sequence
  CG_17_VH_CDR2
TISGSGGSTYYADSVKG

SEQ ID NO: 614 - protein, 7 aa, Artificial Sequence
  CG_17_VH_CDR3
HILRYFD

SEQ ID NO: 615 - protein, 11 aa, Artificial Sequence
  CG_18_VL_CDR1
RASQGISSWLA

SEQ ID NO: 616 - protein, 7 aa, Artificial Sequence
  CG_18_VL_CDR2
AAYVLES

SEQ ID NO: 617 - protein, 9 aa, Artificial Sequence
  CG_18_VL_CDR3
QQANSFPYT

SEQ ID NO: 618 - protein, 5 aa, Artificial Sequence
  CG_18_VH_CDR1
NFVMS

SEQ ID NO: 619 - protein, 17 aa, Artificial Sequence
  CG_18_VH_CDR2
TISGSGGSTYYADSVKG

SEQ ID NO: 620 - protein, 7 aa, Artificial Sequence
  CG_18_VH_CDR3
HILRYFD

SEQ ID NO: 621 - protein, 11 aa, Artificial Sequence
  CG_19_VL_CDR1
RASQGISSWLA

SEQ ID NO: 622 - protein, 7 aa, Artificial Sequence
  CG_19_VL_CDR2
AAQILES

SEQ ID NO: 623 - protein, 9 aa, Artificial Sequence
  CG_19_VL_CDR3
QQANSFPYT

SEQ ID NO: 624 - protein, 5 aa, Artificial Sequence
  CG_19_VH_CDR1
NFVMS

SEQ ID NO: 625 - protein, 17 aa, Artificial Sequence
  CG_19_VH_CDR2
TISGSGGSTYYADSVKG

SEQ ID NO: 626 - protein, 7 aa, Artificial Sequence
  CG_19_VH_CDR3
HILRYFD

SEQ ID NO: 627 - protein, 11 aa, Artificial Sequence
  CG_20_VL_CDR1
RASQGISSWLA

SEQ ID NO: 628 - protein, 7 aa, Artificial Sequence
  CG_20_VL_CDR2
AATILES

SEQ ID NO: 629 - protein, 9 aa, Artificial Sequence
  CG_20_VL_CDR3
QQANSFPYT

SEQ ID NO: 630 - protein, 5 aa, Artificial Sequence
  CG_20_VH_CDR1
NFVMS

SEQ ID NO: 631 - protein, 17 aa, Artificial Sequence
  CG_20_VH_CDR2
TISGSGGSTYYADSVKG

SEQ ID NO: 632 - protein, 7 aa, Artificial Sequence
  CG_20_VH_CDR3
HILRYFD

SEQ ID NO: 633 - protein, 11 aa, Artificial Sequence
  CG_21_VL_CDR1
RASQGISSWLA

SEQ ID NO: 634 - protein, 7 aa, Artificial Sequence
  CG_21_VL_CDR2
AAVFLES

SEQ ID NO: 635 - protein, 9 aa, Artificial Sequence
  CG_21_VL_CDR3
QQANSFPYT

SEQ ID NO: 636 - protein, 5 aa, Artificial Sequence
  CG_21_VH_CDR1
NFVMS

SEQ ID NO: 637 - protein, 17 aa, Artificial Sequence
  CG_21_VH_CDR2
TISGSGGSTYYADSVKG

SEQ ID NO: 638 - protein, 7 aa, Artificial Sequence
  CG_21_VH_CDR3
HILRYFD

SEQ ID NO: 639 - protein, 11 aa, Artificial Sequence
  CG_22_VL_CDR1
RASQGISSWLA

SEQ ID NO: 640 - protein, 7 aa, Artificial Sequence
  CG_22_VL_CDR2
AAVYLES

SEQ ID NO: 641 - protein, 9 aa, Artificial Sequence
  CG_22_VL_CDR3
QQANSFPYT

SEQ ID NO: 642 - protein, 5 aa, Artificial Sequence
  CG_22_VH_CDR1
NFVMS

SEQ ID NO: 643 - protein, 17 aa, Artificial Sequence
  CG_22_VH_CDR2
TISGSGGSTYYADSVKG

SEQ ID NO: 644 - protein, 7 aa, Artificial Sequence
  CG_22_VH_CDR3
HILRYFD

SEQ ID NO: 645 - protein, 11 aa, Artificial Sequence
  CG_23_VL_CDR1
RASQGITSWLA

SEQ ID NO: 646 - protein, 7 aa, Artificial Sequence
  CG_23_VL_CDR2
AASVLES

SEQ ID NO: 647 - protein, 9 aa, Artificial Sequence
  CG_23_VL_CDR3
QQANSFPYT

SEQ ID NO: 648 - protein, 5 aa, Artificial Sequence
  CG_23_VH_CDR1
NFVMS

SEQ ID NO: 649 - protein, 17 aa, Artificial Sequence
  CG_23_VH_CDR2
TISGSGGSTYYADSVKG

SEQ ID NO: 650 - protein, 7 aa, Artificial Sequence
  CG_23_VH_CDR3
HILRYFD

SEQ ID NO: 651 - protein, 11 aa, Artificial Sequence
  CG_24_VL_CDR1
RASQSISSWLA

SEQ ID NO: 652 - protein, 7 aa, Artificial Sequence
  CG_24_VL_CDR2
AASVLES

SEQ ID NO: 653 - protein, 9 aa, Artificial Sequence
  CG_24_VL_CDR3
QQANSFPYT

SEQ ID NO: 654 - protein, 5 aa, Artificial Sequence
  CG_24_VH_CDR1
NFVMS

SEQ ID NO: 655 - protein, 17 aa, Artificial Sequence
  CG_24_VH_CDR2
TISGSGGSTYYADSVKG

SEQ ID NO: 656 - protein, 7 aa, Artificial Sequence
  CG_24_VH_CDR3
HILRYFD

SEQ ID NO: 657 - protein, 11 aa, Artificial Sequence
  CG_25_VL_CDR1
RASQGVSSWLA

SEQ ID NO: 658 - protein, 7 aa, Artificial Sequence
  CG_25_VL_CDR2
AASVLES

SEQ ID NO: 659 - protein, 9 aa, Artificial Sequence
  CG_25_VL_CDR3
QQANSFPYT

SEQ ID NO: 660 - protein, 5 aa, Artificial Sequence
  CG_25_VH_CDR1
NFVMS

SEQ ID NO: 661 - protein, 17 aa, Artificial Sequence
  CG_25_VH_CDR2
TISGSGGSTYYADSVKG

SEQ ID NO: 662 - protein, 7 aa, Artificial Sequence
  CG_25_VH_CDR3
HILRYFD

SEQ ID NO: 663 - protein, 11 aa, Artificial Sequence
  CG_26_VL_CDR1
RASQGLSSWLA

SEQ ID NO: 664 - protein, 7 aa, Artificial Sequence
  CG_26_VL_CDR2
AASVLES

SEQ ID NO: 665 - protein, 9 aa, Artificial Sequence
  CG_26_VL_CDR3
QQANSFPYT

SEQ ID NO: 666 - protein, 5 aa, Artificial Sequence
  CG_26_VH_CDR1
NFVMS

SEQ ID NO: 667 - protein, 17 aa, Artificial Sequence
  CG_26_VH_CDR2
TISGSGGSTYYADSVKG

SEQ ID NO: 668 - protein, 7 aa, Artificial Sequence
  CG_26_VH_CDR3
HILRYFD

SEQ ID NO: 669 - protein, 11 aa, Artificial Sequence
  CG_27_VL_CDR1
RASEGISSWLA

SEQ ID NO: 670 - protein, 7 aa, Artificial Sequence
  CG_27_VL_CDR2
AASVLES

SEQ ID NO: 671 - protein, 9 aa, Artificial Sequence
  CG_27_VL_CDR3
QQANSFPYT

SEQ ID NO: 672 - protein, 5 aa, Artificial Sequence
  CG_27_VH_CDR1
NFVMS

SEQ ID NO: 673 - protein, 17 aa, Artificial Sequence
  CG_27_VH_CDR2
TISGSGGSTYYADSVKG

SEQ ID NO: 674 - protein, 7 aa, Artificial Sequence
  CG_27_VH_CDR3
HILRYFD

SEQ ID NO: 675 - protein, 11 aa, Artificial Sequence
  CG_28_VL_CDR1
RASQYIESWLA

SEQ ID NO: 676 - protein, 7 aa, Artificial Sequence
  CG_28_VL_CDR2
AASVLES

SEQ ID NO: 677 - protein, 9 aa, Artificial Sequence
  CG_28_VL_CDR3
QQANSFPYT

SEQ ID NO: 678 - protein, 5 aa, Artificial Sequence
  CG_28_VH_CDR1
NFVMS

SEQ ID NO: 679 - protein, 17 aa, Artificial Sequence
  CG_28_VH_CDR2
TISGSGGSTYYADSVKG

SEQ ID NO: 680 - protein, 7 aa, Artificial Sequence
  CG_28_VH_CDR3
HILRYFD

SEQ ID NO: 681 - protein, 11 aa, Artificial Sequence
  CG_29_VL_CDR1
RASQHITSWLA

SEQ ID NO: 682 - protein, 7 aa, Artificial Sequence
  CG_29_VL_CDR2
AASVLES

SEQ ID NO: 683 - protein, 9 aa, Artificial Sequence
  CG_29_VL_CDR3
QQANSFPYT

SEQ ID NO: 684 - protein, 5 aa, Artificial Sequence
  CG_29_VH_CDR1
NFVMS

SEQ ID NO: 685 - protein, 17 aa, Artificial Sequence
  CG_29_VH_CDR2
TISGSGGSTYYADSVKG

SEQ ID NO: 686 - protein, 7 aa, Artificial Sequence
  CG_29_VH_CDR3
HILRYFD

SEQ ID NO: 687 - protein, 11 aa, Artificial Sequence
  CG_30_VL_CDR1
RATEGISSWLA

SEQ ID NO: 688 - protein, 7 aa, Artificial Sequence
  CG_30_VL_CDR2
AASVLES

SEQ ID NO: 689 - protein, 9 aa, Artificial Sequence
  CG_30_VL_CDR3
QQANSFPYT

SEQ ID NO: 690 - protein, 5 aa, Artificial Sequence
  CG_30_VH_CDR1
NFVMS

SEQ ID NO: 691 - protein, 17 aa, Artificial Sequence
  CG_30_VH_CDR2
TISGSGGSTYYADSVKG

SEQ ID NO: 692 - protein, 7 aa, Artificial Sequence
  CG_30_VH_CDR3
HILRYFD

SEQ ID NO: 693 - protein, 11 aa, Artificial Sequence
  CG_31_VL_CDR1
RASQYIQSWLA

SEQ ID NO: 694 - protein, 7 aa, Artificial Sequence
  CG_31_VL_CDR2
AASVLES

SEQ ID NO: 695 - protein, 9 aa, Artificial Sequence
  CG_31_VL_CDR3
QQANSFPYT

SEQ ID NO: 696 - protein, 5 aa, Artificial Sequence
  CG_31_VH_CDR1
NFVMS

SEQ ID NO: 697 - protein, 17 aa, Artificial Sequence
  CG_31_VH_CDR2
TISGSGGSTYYADSVKG

SEQ ID NO: 698 - protein, 7 aa, Artificial Sequence
  CG_31_VH_CDR3
HILRYFD

SEQ ID NO: 699 - protein, 11 aa, Artificial Sequence
  CG_32_VL_CDR1
RASQYISSWLA

SEQ ID NO: 700 - protein, 7 aa, Artificial Sequence
  CG_32_VL_CDR2
AASVLES

SEQ ID NO: 701 - protein, 9 aa, Artificial Sequence
  CG_32_VL_CDR3
QQANSFPYT

SEQ ID NO: 702 - protein, 5 aa, Artificial Sequence
  CG_32_VH_CDR1
NFVMS

SEQ ID NO: 703 - protein, 17 aa, Artificial Sequence
  CG_32_VH_CDR2
TISGSGGSTYYADSVKG

SEQ ID NO: 704 - protein, 7 aa, Artificial Sequence
  CG_32_VH_CDR3
HILRYFD

SEQ ID NO: 705 - protein, 11 aa, Artificial Sequence
  CG_33_VL_CDR1
RASQYIASWLA

SEQ ID NO: 706 - protein, 7 aa, Artificial Sequence
  CG_33_VL_CDR2
AASVLES

SEQ ID NO: 707 - protein, 9 aa, Artificial Sequence
  CG_33_VL_CDR3
QQANSFPYT

SEQ ID NO: 708 - protein, 5 aa, Artificial Sequence
  CG_33_VH_CDR1
NFVMS

SEQ ID NO: 709 - protein, 17 aa, Artificial Sequence
  CG_33_VH_CDR2
TISGSGGSTYYADSVKG

SEQ ID NO: 710 - protein, 7 aa, Artificial Sequence
  CG_33_VH_CDR3
HILRYFD

SEQ ID NO: 711 - protein, 11 aa, Artificial Sequence
  CG_34_VL_CDR1
RASQYITSWLA

SEQ ID NO: 712 - protein, 7 aa, Artificial Sequence
  CG_34_VL_CDR2
AASVLES

SEQ ID NO: 713 - protein, 9 aa, Artificial Sequence
  CG_34_VL_CDR3
QQANSFPYT

SEQ ID NO: 714 - protein, 5 aa, Artificial Sequence
  CG_34_VH_CDR1
NFVMS

SEQ ID NO: 715 - protein, 17 aa, Artificial Sequence
  CG_34_VH_CDR2
TISGSGGSTYYADSVKG

SEQ ID NO: 716 - protein, 7 aa, Artificial Sequence
  CG_34_VH_CDR3
HILRYFD

SEQ ID NO: 717 - protein, 11 aa, Artificial Sequence
  CG_35_VL_CDR1
RASQGISSWLA

SEQ ID NO: 718 - protein, 7 aa, Artificial Sequence
  CG_35_VL_CDR2
AASVLES

SEQ ID NO: 719 - protein, 9 aa, Artificial Sequence
  CG_35_VL_CDR3
QQANSFPYT

SEQ ID NO: 720 - protein, 5 aa, Artificial Sequence
  CG_35_VH_CDR1
NFVMS

SEQ ID NO: 721 - protein, 17 aa, Artificial Sequence
  CG_35_VH_CDR2
TISGSGGSTYYADSVKG

SEQ ID NO: 722 - protein, 7 aa, Artificial Sequence
  CG_35_VH_CDR3
HILRYFD

SEQ ID NO: 723 - protein, 11 aa, Artificial Sequence
  CG_36_VL_CDR1
RASQGISSWLA

SEQ ID NO: 724 - protein, 7 aa, Artificial Sequence
  CG_36_VL_CDR2
AASVLES

SEQ ID NO: 725 - protein, 9 aa, Artificial Sequence
  CG_36_VL_CDR3
QQANSFPYT

SEQ ID NO: 726 - protein, 5 aa, Artificial Sequence
  CG_36_VH_CDR1
NFVMS

SEQ ID NO: 727 - protein, 17 aa, Artificial Sequence
  CG_36_VH_CDR2
TISGSGGSTYYADSVKG

SEQ ID NO: 728 - protein, 8 aa, Artificial Sequence
  CG_36_VH_CDR3
HSILRYFD

SEQ ID NO: 729 - protein, 11 aa, Artificial Sequence
  CG_37_VL_CDR1
RASQGISSWLA

SEQ ID NO: 730 - protein, 7 aa, Artificial Sequence
  CG_37_VL_CDR2
AASVLES

SEQ ID NO: 731 - protein, 9 aa, Artificial Sequence
  CG_37_VL_CDR3
QQANSFPYT

SEQ ID NO: 732 - protein, 5 aa, Artificial Sequence
  CG_37_VH_CDR1
NFVMS

SEQ ID NO: 733 - protein, 17 aa, Artificial Sequence
  CG_37_VH_CDR2
TISGSGGSTYYADSVKG

SEQ ID NO: 734 - protein, 8 aa, Artificial Sequence
  CG_37_VH_CDR3
HTILRYFD

SEQ ID NO: 735 - protein, 11 aa, Artificial Sequence
  CG_38_VL_CDR1
RASQGISSWLA

SEQ ID NO: 736 - protein, 7 aa, Artificial Sequence
  CG_38_VL_CDR2
AASVLES

SEQ ID NO: 737 - protein, 9 aa, Artificial Sequence
  CG_38_VL_CDR3
QQANSFPYT

SEQ ID NO: 738 - protein, 5 aa, Artificial Sequence
  CG_38_VH_CDR1
NFVMS

SEQ ID NO: 739 - protein, 17 aa, Artificial Sequence
  CG_38_VH_CDR2
TISGSGGSTYYADSVKG

SEQ ID NO: 740 - protein, 7 aa, Artificial Sequence
  CG_38_VH_CDR3
HILRSFD

SEQ ID NO: 741 - protein, 11 aa, Artificial Sequence
  CG_39_VL_CDR1
RASQGISSWLA

SEQ ID NO: 742 - protein, 7 aa, Artificial Sequence
  CG_39_VL_CDR2
AASVLES

SEQ ID NO: 743 - protein, 9 aa, Artificial Sequence
  CG_39_VL_CDR3
QQANSFPYT

SEQ ID NO: 744 - protein, 5 aa, Artificial Sequence
  CG_39_VH_CDR1
NFVMS

SEQ ID NO: 745 - protein, 17 aa, Artificial Sequence
  CG_39_VH_CDR2
TISGSGGSTYYADSVKG

SEQ ID NO: 746 - protein, 7 aa, Artificial Sequence
  CG_39_VH_CDR3
HILKYFD

SEQ ID NO: 747 - protein, 11 aa, Artificial Sequence
  CG_40_VL_CDR1
RASQGISSWLA

SEQ ID NO: 748 - protein, 7 aa, Artificial Sequence
  CG_40_VL_CDR2
AASVLES

SEQ ID NO: 749 - protein, 9 aa, Artificial Sequence
  CG_40_VL_CDR3
QQANSFPYT

SEQ ID NO: 750 - protein, 5 aa, Artificial Sequence
  CG_40_VH_CDR1
NFVMS

SEQ ID NO: 751 - protein, 17 aa, Artificial Sequence
  CG_40_VH_CDR2
TISGSGGSTYYADSVKG

SEQ ID NO: 752 - protein, 7 aa, Artificial Sequence
  CG_40_VH_CDR3
HVIRYFD

SEQ ID NO: 753 - protein, 11 aa, Artificial Sequence
  CG_41_VL_CDR1
RASQGISSWLA

SEQ ID NO: 754 - protein, 7 aa, Artificial Sequence
  CG_41_VL_CDR2
AASVLES

SEQ ID NO: 755 - protein, 9 aa, Artificial Sequence
  CG_41_VL_CDR3
QQANSFPYT

SEQ ID NO: 756 - protein, 5 aa, Artificial Sequence
  CG_41_VH_CDR1
NFVMS

SEQ ID NO: 757 - protein, 17 aa, Artificial Sequence
  CG_41_VH_CDR2
TISGSGGSTYYADSVKG

SEQ ID NO: 758 - protein, 8 aa, Artificial Sequence
  CG_41_VH_CDR3
HVILRYFD

SEQ ID NO: 759 - protein, 11 aa, Artificial Sequence
  CG_42_VL_CDR1
RASQGISSWLA

SEQ ID NO: 760 - protein, 7 aa, Artificial Sequence
  CG_42_VL_CDR2
AASVLES

SEQ ID NO: 761 - protein, 9 aa, Artificial Sequence
  CG_42_VL_CDR3
QQANSFPYT

SEQ ID NO: 762 - protein, 5 aa, Artificial Sequence
  CG_42_VH_CDR1
NFVMS

SEQ ID NO: 763 - protein, 17 aa, Artificial Sequence
  CG_42_VH_CDR2
TISGSGGSTYYADSVKG

SEQ ID NO: 764 - protein, 8 aa, Artificial Sequence
  CG_42_VH_CDR3
HYILRYFD

SEQ ID NO: 765 - protein, 11 aa, Artificial Sequence
  CG_43_VL_CDR1
RASQGISSWLA

SEQ ID NO: 766 - protein, 7 aa, Artificial Sequence
  CG_43_VL_CDR2
AASVLES

SEQ ID NO: 767 - protein, 9 aa, Artificial Sequence
  CG_43_VL_CDR3
QQANSFPYT

SEQ ID NO: 768 - protein, 5 aa, Artificial Sequence
  CG_43_VH_CDR1
NFVMS

SEQ ID NO: 769 - protein, 17 aa, Artificial Sequence
  CG_43_VH_CDR2
TISGSGGSTYYADSVKG

SEQ ID NO: 770 - protein, 8 aa, Artificial Sequence
  CG_43_VH_CDR3
HLYLRYFD

SEQ ID NO: 771 - protein, 11 aa, Artificial Sequence
  CG_44_VL_CDR1
RASQGISSWLA

SEQ ID NO: 772 - protein, 7 aa, Artificial Sequence
  CG_44_VL_CDR2
AASVLES

SEQ ID NO: 773 - protein, 9 aa, Artificial Sequence
  CG_44_VL_CDR3
QQANSFPYT

SEQ ID NO: 774 - protein, 5 aa, Artificial Sequence
  CG_44_VH_CDR1
NFVMS

SEQ ID NO: 775 - protein, 17 aa, Artificial Sequence
  CG_44_VH_CDR2
TISGAGGSTYYADSVKG

SEQ ID NO: 776 - protein, 7 aa, Artificial Sequence
  CG_44_VH_CDR3
HILRYFD

SEQ ID NO: 777 - protein, 11 aa, Artificial Sequence
  CG_45_VL_CDR1
RASQGISSWLA

SEQ ID NO: 778 - protein, 7 aa, Artificial Sequence
  CG_45_VL_CDR2
AASVLES

SEQ ID NO: 779 - protein, 9 aa, Artificial Sequence
  CG_45_VL_CDR3
QQANSFPYT

SEQ ID NO: 780 - protein, 5 aa, Artificial Sequence
  CG_45_VH_CDR1
NFVMS

SEQ ID NO: 781 - protein, 17 aa, Artificial Sequence
  CG_45_VH_CDR2
TISGSGGSSYYADSVKG

SEQ ID NO: 782 - protein, 7 aa, Artificial Sequence
  CG_45_VH_CDR3
HILRYFD

SEQ ID NO: 783 - protein, 11 aa, Artificial Sequence
  CG_46_VL_CDR1
RASQGISSWLA

SEQ ID NO: 784 - protein, 7 aa, Artificial Sequence
  CG_46_VL_CDR2
AASVLES

SEQ ID NO: 785 - protein, 9 aa, Artificial Sequence
  CG_46_VL_CDR3
QQANSFPYT

SEQ ID NO: 786 - protein, 5 aa, Artificial Sequence
  CG_46_VH_CDR1
NFVMS

SEQ ID NO: 787 - protein, 17 aa, Artificial Sequence
  CG_46_VH_CDR2
TISGTGGSTYYADSVKG

SEQ ID NO: 788 - protein, 7 aa, Artificial Sequence
  CG_46_VH_CDR3
HILRYFD

SEQ ID NO: 789 - protein, 11 aa, Artificial Sequence
  CG_47_VL_CDR1
RASQGISSWLA

SEQ ID NO: 790 - protein, 7 aa, Artificial Sequence
  CG_47_VL_CDR2
AASVLES

SEQ ID NO: 791 - protein, 9 aa, Artificial Sequence
  CG_47_VL_CDR3
QQANSFPYT

SEQ ID NO: 792 - protein, 5 aa, Artificial Sequence
  CG_47_VH_CDR1
NFVMS

SEQ ID NO: 793 - protein, 17 aa, Artificial Sequence
  CG_47_VH_CDR2
TISGTGSSTYYADSVKG

SEQ ID NO: 794 - protein, 7 aa, Artificial Sequence
  CG_47_VH_CDR3
HILRYFD

SEQ ID NO: 795 - protein, 11 aa, Artificial Sequence
  CG_48_VL_CDR1
RASQGISSWLA

SEQ ID NO: 796 - protein, 7 aa, Artificial Sequence
  CG_48_VL_CDR2
AASVLES

SEQ ID NO: 797 - protein, 9 aa, Artificial Sequence
  CG_48_VL_CDR3
QQANSFPYT

SEQ ID NO: 798 - protein, 5 aa, Artificial Sequence
  CG_48_VH_CDR1
NFVMS

SEQ ID NO: 799 - protein, 17 aa, Artificial Sequence
  CG_48_VH_CDR2
TISGYGGSTYYADSVKG

SEQ ID NO: 800 - protein, 7 aa, Artificial Sequence
  CG_48_VH_CDR3
HILRYFD

SEQ ID NO: 801 - protein, 11 aa, Artificial Sequence
  CG_49_VL_CDR1
RASQGISSWLA

SEQ ID NO: 802 - protein, 7 aa, Artificial Sequence
  CG_49_VL_CDR2
AASVLES

SEQ ID NO: 803 - protein, 9 aa, Artificial Sequence
  CG_49_VL_CDR3
QQANSFPYT

SEQ ID NO: 804 - protein, 5 aa, Artificial Sequence
  CG_49_VH_CDR1
NFVMS

SEQ ID NO: 805 - protein, 17 aa, Artificial Sequence
  CG_49_VH_CDR2
TISGHGGSTYYADSVKG

SEQ ID NO: 806 - protein, 7 aa, Artificial Sequence
  CG_49_VH_CDR3
HILRYFD

SEQ ID NO: 807 - protein, 11 aa, Artificial Sequence
  CG_50_VL_CDR1
RASQGISSWLA

SEQ ID NO: 808 - protein, 7 aa, Artificial Sequence
  CG_50_VL_CDR2
AASVLES

SEQ ID NO: 809 - protein, 9 aa, Artificial Sequence
  CG_50_VL_CDR3
QQANSFPYT

SEQ ID NO: 810 - protein, 5 aa, Artificial Sequence
  CG_50_VH_CDR1
NFVMS

SEQ ID NO: 811 - protein, 17 aa, Artificial Sequence
  CG_50_VH_CDR2
TISGHGGATYYADSVKG

SEQ ID NO: 812 - protein, 7 aa, Artificial Sequence
  CG_50_VH_CDR3
HILRYFD

SEQ ID NO: 813 - protein, 11 aa, Artificial Sequence
  CG_51_VL_CDR1
RASQGISSWLA

SEQ ID NO: 814 - protein, 7 aa, Artificial Sequence
  CG_51_VL_CDR2
AASVLES

SEQ ID NO: 815 - protein, 9 aa, Artificial Sequence
  CG_51_VL_CDR3
QQANSFPYT

SEQ ID NO: 816 - protein, 5 aa, Artificial Sequence
  CG_51_VH_CDR1
NFVMS

SEQ ID NO: 817 - protein, 17 aa, Artificial Sequence
  CG_51_VH_CDR2
TISGEGGLTYYADSVKG

SEQ ID NO: 818 - protein, 7 aa, Artificial Sequence
  CG_51_VH_CDR3
HILRYFD

SEQ ID NO: 819 - protein, 11 aa, Artificial Sequence
  CG_52_VL_CDR1
RASQGISSWLA

SEQ ID NO: 820 - protein, 7 aa, Artificial Sequence
  CG_52_VL_CDR2
AASVLES

SEQ ID NO: 821 - protein, 9 aa, Artificial Sequence
  CG_52_VL_CDR3
QQANSFPYT

SEQ ID NO: 822 - protein, 5 aa, Artificial Sequence
  CG_52_VH_CDR1
NFVMS

SEQ ID NO: 823 - protein, 17 aa, Artificial Sequence
  CG_52_VH_CDR2
TISGHGGTTYYADSVKG

SEQ ID NO: 824 - protein, 7 aa, Artificial Sequence
  CG_52_VH_CDR3
HILRYFD

SEQ ID NO: 825 - protein, 11 aa, Artificial Sequence
  CG_53_VL_CDR1
RASQGISSWLA

SEQ ID NO: 826 - protein, 7 aa, Artificial Sequence
  CG_53_VL_CDR2
AASVLES

SEQ ID NO: 827 - protein, 9 aa, Artificial sequence
  CG_53_VL_CDR3
QQANSFPYT

SEQ ID NO: 828 - protein, 5 aa, Artificial Sequence
  CG_53_VH_CDR1
NFVMS

SEQ ID NO: 829 - protein, 17 aa, Artificial Sequence
  CG_53_VH_CDR2
TISGYGGTTYYADSVKG

SEQ ID NO: 830 - protein, 7 aa, Artificial Sequence
  CG_53_VH_CDR3
HILRYFD

SEQ ID NO: 831 - protein, 11 aa, Artificial Sequence
  CG_54_VL_CDR1
RASQGISSWLA

SEQ ID NO: 832 - protein, 7 aa, Artificial Sequence
  CG_54_VL_CDR2
AASVLES

SEQ ID NO: 833 - protein, 9 aa, Artificial Sequence
  CG_54_VL_CDR3
QQANSFPYT

SEQ ID NO: 834 - protein, 5 aa, Artificial Sequence
  CG_54_VH_CDR1
NFVMS

SEQ ID NO: 835 - protein, 17 aa, Artificial Sequence
  CG_54_VH_CDR2
TISGYGGATYYADSVKG

SEQ ID NO: 836 - protein, 7 aa, Artificial Sequence
  CG_54_VH_CDR3
HILRYFD

SEQ ID NO: 837 - protein, 11 aa, Artificial Sequence
  CG_55_VL_CDR1
RASQGISSWLA

SEQ ID NO: 838 - protein, 7 aa, Artificial Sequence
  CG_55_VL_CDR2
AASVLES

SEQ ID NO: 839 - protein, 9 aa, Artificial Sequence
  CG_55_VL_CDR3
QQANSFPYT

SEQ ID NO: 840 - protein, 5 aa, Artificial Sequence
  CG_55_VH_CDR1
NFVMS

SEQ ID NO: 841 - protein, 17 aa, Artificial Sequence
  CG_55_VH_CDR2
TISGDGGLTYYADSVKG

SEQ ID NO: 842 - protein, 7 aa, Artificial Sequence
  CG_55_VH_CDR3
HILRYFD

SEQ ID NO: 843 - protein, 11 aa, Artificial Sequence
  CG_56_VL_CDR1
RASQGISSWLA

SEQ ID NO: 844 - protein, 7 aa, Artificial Sequence
  CG_56_VL_CDR2
AASVLES

SEQ ID NO: 845 - protein, 9 aa, Artificial Sequence
  CG_56_VL_CDR3
QQANSFPYT

SEQ ID NO: 846 - protein, 5 aa, Artificial Sequence
  CG_56_VH_CDR1
NFVMS

SEQ ID NO: 847 - protein, 17 aa, Artificial Sequence
  CG_56_VH_CDR2
TISGTGGLTYYADSVKG

SEQ ID NO: 848 - protein, 7 aa, Artificial Sequence
  CG_56_VH_CDR3
HILRYFD

SEQ ID NO: 849 - protein, 11 aa, Artificial Sequence
  CG_57_VL_CDR1
RASQGISSWLA

SEQ ID NO: 850 - protein, 7 aa, Artificial Sequence
  CG_57_VL_CDR2
AASVLES

SEQ ID NO: 851 - protein, 9 aa, Artificial Sequence
  CG_57_VL_CDR3
QQANSFPYT

SEQ ID NO: 852 - protein, 5 aa, Artificial Sequence
  CG_57_VH_CDR1
DFVMS

SEQ ID NO: 853 - protein, 17 aa, Artificial Sequence
  CG_57_VH_CDR2
TISGSGGSTYYADSVKG

SEQ ID NO: 854 - protein, 7 aa, Artificial Sequence
  CG_57_VH_CDR3
HILRYFD

SEQ ID NO: 855 - protein, 11 aa, Artificial Sequence
  CG_58_VL_CDR1
RASQGISSWLA

SEQ ID NO: 856 - protein, 7 aa, Artificial Sequence
  CG_58_VL_CDR2
AASVLES

SEQ ID NO: 857 - protein, 9 aa, Artificial Sequence
  CG_58_VL_CDR3
QQANSFPYT

SEQ ID NO: 858 - protein, 5 aa, Artificial Sequence
  CG_58_VH_CDR1
EFVMS

SEQ ID NO: 859 - protein, 17 aa, Artificial Sequence
  CG_58_VH_CDR2
TISGSGGSTYYADSVKG

SEQ ID NO: 860 - protein, 7 aa, Artificial Sequence
  CG_58_VH_CDR3
HILRYFD

SEQ ID NO: 861 - protein, 11 aa, Artificial Sequence
  CG_59_VL_CDR1
RASQGISSWLA

SEQ ID NO: 862 - protein, 7 aa, Artificial Sequence
  CG_59_VL_CDR2
AASVLES

SEQ ID NO: 863 - protein, 9 aa, Artificial Sequence
  CG_59_VL_CDR3
QQANSFPYT

SEQ ID NO: 864 - protein, 5 aa, Artificial Sequence
  CG_59_VH_CDR1
QFVMS

SEQ ID NO: 865 - protein, 17 aa, Artificial Sequence
  CG_59_VH_CDR2
TISGSGGSTYYADSVKG

SEQ ID NO: 866 - protein, 7 aa, Artificial Sequence
  CG_59_VH_CDR3
HILRYFD

SEQ ID NO: 867 - protein, 11 aa, Artificial Sequence
  CG_60_VL_CDR1
RASQGISSWLA

SEQ ID NO: 868 - protein, 7 aa, Artificial Sequence
  CG_60_VL_CDR2
AASVLES

SEQ ID NO: 869 - protein, 9 aa, Artificial Sequence
  CG_60_VL_CDR3
QQANSFPYT

SEQ ID NO: 870 - protein, 6 aa, Artificial Sequence
  CG_60_VH_CDR1
VNFVMS

SEQ ID NO: 871 - protein, 17 aa, Artificial Sequence
  CG_60_VH_CDR2
TISGSGGSTYYADSVKG

SEQ ID NO: 872 - protein, 7 aa, Artificial Sequence
  CG_60_VH_CDR3
HILRYFD

SEQ ID NO: 873 - protein, 11 aa, Artificial Sequence
  CG_61_VL_CDR1
RASQGISSWLA

SEQ ID NO: 874 - protein, 7 aa, Artificial Sequence
  CG_61_VL_CDR2
AASVLES

SEQ ID NO: 875 - protein, 9 aa, Artificial Sequence
  CG_61_VL_CDR3
QQANSFPYT

SEQ ID NO: 876 - protein, 6 aa, Artificial Sequence
  CG_61_VH_CDR1
VDFVMS

SEQ ID NO: 877 - protein, 17 aa, Artificial Sequence
  CG_61_VH_CDR2
TISGSGGSTYYADSVKG

SEQ ID NO: 878 - protein, 7 aa, Artificial Sequence
  CG_61_VH_CDR3
HILRYFD

SEQ ID NO: 879 - protein, 11 aa, Artificial Sequence
  CG_62_VL_CDR1
RASQGISSWLA

SEQ ID NO: 880 - protein, 7 aa, Artificial Sequence
  CG_62_VL_CDR2
AASVLES

SEQ ID NO: 881 - protein, 9 aa, Artificial Sequence
  CG_62_VL_CDR3
QQANSFPYT

SEQ ID NO: 882 - protein, 6 aa, Artificial Sequence
  CG_62_VH_CDR1
LDFVMS

SEQ ID NO: 883 - protein, 17 aa, Artificial Sequence
  CG_62_VH_CDR2
TISGSGGSTYYADSVKG

SEQ ID NO: 884 - protein, 7 aa, Artificial Sequence
  CG_62_VH_CDR3
HILRYFD

SEQ ID NO: 885 - protein, 11 aa, Artificial Sequence
  CG_63_VL_CDR1
RASQGISSWLA

SEQ ID NO: 886 - protein, 7 aa, Artificial Sequence
  CG_63_VL_CDR2
AASVLES

SEQ ID NO: 887 - protein, 9 aa, Artificial Sequence
  CG_63_VL_CDR3
QQANSFPYT

SEQ ID NO: 888 - protein, 6 aa, Artificial Sequence
  CG_63_VH_CDR1
YEFVMS

SEQ ID NO: 889 - protein, 17 aa, Artificial Sequence
  CG_63_VH_CDR2
TISGSGGSTYYADSVKG

SEQ ID NO: 890 - protein, 7 aa, Artificial Sequence
  CG_63_VH_CDR3
HILRYFD

SEQ ID NO: 891 - protein, 107 aa, Artificial Sequence; identical to SEQ ID NO: 383
  Anti-CD47 CL-4033_VL

SEQ ID NO: 892 - protein, 117 aa, Artificial Sequence; identical to SEQ ID NO: 388
  Anti-CD47 CL-4033_VH

SEQ ID NO: 893 - protein, 11 aa, Artificial Sequence
  VL CDR1
RASQGISSWLA

SEQ ID NO: 894 - protein, 7 aa, Artificial Sequence
  VL CDR2
AASVLES

SEQ ID NO: 895 - protein, 9 aa, Artificial Sequence
  VL CDR3
QQANSFPYT

SEQ ID NO: 896 - protein, 5 aa, Artificial Sequence
  VH CDR1
NFVMS

SEQ ID NO: 897 - protein, 17 aa, Artificial Sequence
  VH CDR2
TISGSGGSTYYADSVKG

SEQ ID NO: 898 - protein, 8 aa, Artificial Sequence
  VH CDR3
HHILRYFD

SEQ ID NO: 899 - protein, 107 aa, Artificial Sequence; identical to SEQ ID NO: 89
  VL

SEQ ID NO: 900 - protein, 120 aa, Artificial Sequence; identical to SEQ ID NO: 158
  VH

What is claimed is:

1. A bispecific antibody comprising at least one Fab portion that binds CD47 and at least one Fab portion that binds CD20; wherein the Fab portion that binds CD47 comprises:
   (i) a light chain variable region (VL) region comprising VL CDRs RASQGISSWLA (SEQ ID NO:377), AASVLES (SEQ ID NO:378), and QQANSFPYT (SEQ ID NO: 379); and
   (ii) a heavy chain variable region (VH) region comprising VH CDRs NFVMS (SEQ ID NO: 380), TISGSGGSTYYADSVKG (SEQ ID NO:381), and HYILRYFD (SEQ ID NO: 382);
   wherein the bispecific antibody selectively binds B cells; and
   wherein the bispecific antibody is isotype IgG1.

2. A bispecific antibody according to claim 1 wherein the bispecific antibody comprises an anti-CD47 light chain (LC) constant region comprising SEQ ID NO:340.

3. A bispecific antibody according to claim 2 wherein the bispecific antibody comprises an anti-CD47 heavy chain (HC) constant region comprising SEQ ID NO:342.

4. A bispecific antibody according to claim 1 that selectively binds malignant B cells.

5. A bispecific antibody according to claim 3 that selectively binds malignant B cells.

6. A bispecific antibody according to claim 5 wherein the bispecific antibody comprises an anti-CD20 light chain (LC) constant region comprising SEQ ID NO:344.

7. A bispecific antibody according to claim 6 wherein the bispecific antibody comprises an anti-CD20 heavy chain (HC) constant region comprising SEQ ID NO:346.

8. A bispecific antibody according to claim 1 comprising a VL region comprising SEQ ID NO:383; and, a VH region comprising SEQ ID NO:384.

9. A bispecific antibody according to claim 7 comprising anti-CD20 VL CDRs RASSSVSYIH (SEQ ID NO:353), ATSNLAS (SEQ ID NO:354), QQWTSNPPT (SEQ ID NO:355); and, VH CDRs SYNMH (SEQ ID NO:356), AIYPGNGDTSYNQKFKG (SEQ ID NO:357), STYYGGDWYFNV (SEQ ID NO:358).

10. A bispecific antibody according to claim 9 comprising an anti-CD20 VL region comprising SEQ ID NO: 323 and a VH region comprising SEQ ID NO: 324.

11. A bispecific antibody according to claim 10 comprising an anti-CD20 LC region comprising SEQ ID NO:331 and an anti-CD20 HC region comprising SEQ ID NO: 332.

12. A bispecific antibody according to claim 8 comprising anti-CD20 VL CDRs RASSSVSYIH (SEQ ID NO:353), ATSNLAS (SEQ ID NO:354), QQWTSNPPT (SEQ ID NO:355); and, VH CDRs SYNMH (SEQ ID NO:356), AIYPGNGDTSYNQKFKG (SEQ ID NO:357), STYYGGDWYFNV (SEQ ID NO:358).

13. A bispecific antibody according to claim 12 comprising an anti-CD20 VL region comprising SEQ ID NO: 323 and a VH region comprising SEQ ID NO: 324.

14. A bispecific antibody according to claim 13 comprising an anti-CD20 LC region comprising SEQ ID NO:331 and an anti-CD20 HC region comprising SEQ ID NO:332.

15. A bispecific antibody according to claim 14 comprising an anti-CD47 LC region comprising SEQ ID NO:385 and an anti-CD47 HC region comprising SEQ ID NO:386.

16. A pharmaceutical composition for administration to a patient in need thereof comprising
   i) the bispecific antibody of claim 1; and
   ii) at least one pharmaceutically acceptable carrier.

17. A method of treating a B-cell malignancy in a patient comprising administering an effective amount of the bispecific antibody of claim 1.

* * * * *